United States Patent 11,542,490 (RNAS FOR WOUND HEALING) - sequence listing, part 4

SEQ ID NO: 5243 - RNA, 3084 nt, Artificial Sequence
  derived and/or modified CDS sequence (opt11) from Clostridium histolyticum__BAA34542.1__ColH(1-40)_CS-F_ColH(41-1021)
augaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgauga

SEQ ID NO: 5244 - RNA, 3027 nt, Artificial Sequence
  derived and/or modified CDS sequence (opt12) from Clostridium histolyticum__BAA77453.1__ColG(111-1118)
auagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaauga

SEQ ID NO: 5245 - RNA, 3375 nt, Artificial Sequence
  derived and/or modified CDS sequence (opt12) from Clostridium histolyticum__BAA77453.1__ColG(1-110)_CS-F_ColG(111-1118)
augaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaa

SEQ ID NO: 5246 - RNA, 2946 nt, Artificial Sequence
  derived and/or modified CDS sequence (opt12) from Clostridium histolyticum__BAA34542.1__ColH(41-1021)
guacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaa

SEQ ID NO: 5247 - RNA, 3084 nt, Artificial Sequence
  derived and/or modified CDS sequence (opt12) from Clostridium histolyticum__BAA34542.1__ColH(1-40)_CS-F_ColH(41-1021)
augaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaa

SEQ ID NO: 5248 - RNA, 3027 nt, Artificial Sequence
  derived and/or modified CDS sequence (opt13) from Clostridium histolyticum__BAA77453.1__ColG(111-1118)
auagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaa

SEQ ID NO: 5249 - RNA, 3375 nt, Artificial Sequence
  derived and/or modified CDS sequence (opt13) from Clostridium histolyticum__BAA77453.1__ColG(1-110)_CS-F_ColG(111-1118)
augaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaa

SEQ ID NO: 5250 - RNA, 2946 nt, Artificial Sequence
  derived and/or modified CDS sequence (opt13) from Clostridium histolyticum__BAA34542.1__ColH(41-1021)
guacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaa

SEQ ID NO: 5251 - RNA, 3084 nt, Artificial Sequence
  derived and/or modified CDS sequence (opt13) from Clostridium histolyticum__BAA34542.1__ColH(1-40)_CS-F_ColH(41-1021)
augaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaa

SEQ ID NO: 5252 - DNA, 133 bp, Artificial Sequence
  3'-UTR of mouse NADH dehydrogenase (ubiquinone) 1 alpha subcomplex, 1 (Ndufa1)
ggaagcattttcctggctgattaaaagaaattactcagctatggtcatctgttcctgttagaaggctatgcagcatattatatactatgcgcatgttatgaaatgcataataaaaaattttaaaaaatctaaa

SEQ ID NO: 5253 - RNA, 133 nt, Artificial Sequence
  3'-UTR of mouse NADH dehydrogenase (ubiquinone) 1 alpha subcomplex, 1 (Ndufa1) mRNA
ggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaa

SEQ ID NO: 5254 - DNA, 57 bp, Artificial Sequence
  3'-UTR of human proteasome subunit beta 3 (PSMB3)
ccctgttcccagagcccacttttttttctttttttgaaataaaatagcctgtctttc

SEQ ID NO: 5255 - RNA, 57 nt, Artificial Sequence
  3'-UTR of human proteasome subunit beta 3 (PSMB3) mRNA
cccuguucccagagcccacuuuuuuuucuuuuuuugaaauaaaauagccugucuuuc

SEQ ID NO: 5256 - DNA, 70 bp, Artificial Sequence
  3'-UTR of human ribosomal protein S9 (RPS9)
gtccacctgtccctcctgggctgctggattgtctcgttttcctgccaaataaacaggatcagcgctttac

SEQ ID NO: 5257 - RNA, 70 nt, Artificial Sequence
  3'-UTR of human ribosomal protein S9 (RPS9) mRNA
guccaccugucccuccugggcugcuggauugucucguuuuccugccaaauaaacaggaucagcgcuuuac

SEQ ID NO: 5258 - protein, 209 aa, Artificial Sequence
  derived and/or modified protein sequence (wt) from Homo sapiens__NP_061986.1__HsFGF21(L126R,P199G,A208E)
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 5259 - protein, 728 aa, Artificial Sequence
  derived and/or modified protein sequence (wt) from Mus musculus__NP_001276387.1__MmHGF
MMWGTKLLPVLLLQHVLLHLLLLHVAIPYAEGQKKRRNTLHEFKKSAKTTLTKEDPLLKIKTKKVNSADECANRCIRNRGFTFTCKAFVFDKSRKRCYWYPFNSMSSGVKKGFGHEFDLYENKDYIRNCIIGKGGSYKGTVSITKSGIKCQPWNSMIPHEHSFLPSSYRGKDLQENYCRNPRGEEGGPWCFTSNPEVRYEVCDIPQCSEVECMTCNGESYRGPMDHTESGKTCQRWDQQTPHRHKFLPERYPDKGFDDNYCRNPDGKPRPWCYTLDPDTPWEYCAIKTCAHSAVNETDVPMETTECIQGQGEGYRGTSNTIWNGIPCQRWDSQYPHKHDITPENFKCKDLRENYCRNPDGAESPWCFTTDPNIRVGYCSQIPKCDVSSGQDCYRGNGKNYMGNLSKTRSGLTCSMWDKNMEDLHRHIFWEPDASKLNKNYCRNPDDDAHGPWCYTGNPLIPWDYCPISRCEGDTTPTIVNLDHPVISCAKTKQLRVVNGIPTQTTVGWMVSLKYRNKHICGGSLIKESWVLTARQCFPARNKDLKDYEAWLGIHDVHERGEEKRKQILNISQLVYGPEGSDLVLLKLARPAILDNFVSTIDLPSYGCTIPEKTTCSIYGWGYTGLINADGLLRVAHLYIMGNEKCSQHHQGKVTLNESELCAGAEKIGSGPCEGDYGGPLICEQHKMRMVLGVIVPGRGCAIPNRPGIFVRVAYYAKWIHKVILTYKL

SEQ ID NO: 5260 - protein, 215 aa, Artificial Sequence
  derived and/or modified protein sequence (wt) from Homo sapiens__NP_002119.1__HsHMGB1
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 5261 - protein, 214 aa, Artificial Sequence
  derived and/or modified protein sequence (wt) from Mus musculus__NP_001273985.1__MmVEGFA
MNFLLSWVHWTLALLLYLHHAKWSQAAPTTEGEQKSHEVIKFMDVYQRSYCRPIETLVDIFQEYPDEIEYIFKPSCVPLMRCAGCCNDEALECVPTSESNITMQIMRIKPHQSQHIGEMSFLQHSRCECRPKKDRTKPEKKSVRGKGKGQKRKRKKSRFKSWSVHCEPCSERRKHLFVQDPQTCKCSCKNTDSRCKARQLELNERTCRCDKPRR

SEQ ID NO: 5262 - RNA, 630 nt, Artificial Sequence
  derived and/or modified protein sequence (wt) from Homo sapiens__NP_061986.1__HsFGF21(L126R,P199G,A208E)
auggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccuga

SEQ ID NO: 5263 - RNA, 630 nt, Artificial Sequence
  derived and/or modified protein sequence (wt) from Homo sapiens__NP_061986.1__HsFGF21(L126R,P199G,A208E)
auggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccuga

SEQ ID NO: 5264 - RNA, 2187 nt, Artificial Sequence
  derived and/or modified protein sequence (wt) from Mus musculus__NP_001276387.1__MmHGF
augaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaauuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauucccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcuuggcuuggcauccacgauguucaugagagaggcgaggagaagcgcaagcagaucuuaaacauuucccagcuggucuaugguccugaaggcucagacuugguuuuacugaagcuugcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaa

SEQ ID NO: 5265 - RNA, 2187 nt, Artificial Sequence
  derived and/or modified protein sequence (wt) from Mus musculus__NP_001276387.1__MmHGF
augaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaacuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauccccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcauggcuuggcauccacgauguucaugagagaggcgaggagaagcgcaagcagaucuuaaacauuucccagcuggucuaugguccugaaggcucagacuugguuuuacugaagcuggcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaa

SEQ ID NO: 5266 - RNA, 648 nt, Artificial Sequence
  derived and/or modified protein sequence (wt) from Homo sapiens__NP_002119.1__HsHMGB1
augggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaagcggacaaggcccguuaugaaagagaaaugaaaaccuauaucccucccaaaggggagacaaaaaagaaguucaaggaucccaaugcacccaagaggccuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaugaagaagaagaugaugaugaugaauaa

SEQ ID NO: 5267 - RNA, 645 nt, Artificial Sequence
  derived and/or modified protein sequence (wt) from Mus musculus__NP_001273985.1__MmVEGFA
augaacuuucugcucucuugggugcacuggacccuggcuuuacugcuguaccuccaccaugccaaguggucccaggcugcacccacgacagaaggagagcagaagucccaugaagugaucaaguucauggaugucuaccagcgaagcuacugccguccgauugagacccugguggacaucuuccaggaguaccccgacgagauagaguacaucuucaagccguccugugugccgcugaugcgcugugcaggcugcuguaacgaugaagcccuggagugcgugcccacgucagagagcaacaucaccaugcagaucaugcggaucaaaccucaccaaagccagcacauaggagagaugagcuuccuacagcacagcagaugugaaugcagaccaaagaaagacagaacaaagccagaaaaaaaaucaguucgaggaaagggaaagggucaaaaacgaaagcgcaagaaaucccgguuuaaauccuggagcguucacugugagccuuguucagagcggagaaagcauuuguuuguccaagauccgcagacguguaaauguuccugcaaaaacacagacucgcguugcaaggcgaggcagcuugaguuaaacgaacguacuugcagaugugacaagccaaggcgguga

SEQ ID NO: 5268 - RNA, 630 nt, Artificial Sequence
  derived and/or modified protein sequence (opt1) from Homo sapiens__NP_061986.1__HsFGF21(L126R,P199G,A208E)
auggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcgccugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggggcucccagggccggagccccuccuacgagagcuga

SEQ ID NO: 5269 - RNA, 2187 nt, Artificial Sequence
  derived and/or modified protein sequence (opt1) from Mus musculus__NP_001276387.1__MmHGF
augauguggggcaccaagcugcuccccgugcugcugcuccagcacguccugcugcaccuccugcugcuccacguggccaucccguacgccgaggggcagaagaagcgccggaacacccugcacgaguucaagaagagcgcgaagacgacccugaccaaggaggacccccuccugaagaucaagaccaagaaggugaacuccgccgacgagugcgccaaccgcugcauccggaaccgcggcuucacguucaccugcaaggccuucgucuucgacaagagccggaagcgcugcuacugguaccccuucaacuccaugagcuccggggugaagaagggcuucgggcacgaguucgaccuguacgagaacaaggacuacauccggaacugcaucaucggcaagggcgggagcuacaagggcaccguguccaucaccaagagcgggaucaagugccagcccuggaacuccaugaucccgcacgagcacagcuuccuccccuccagcuaccgcggcaaggaccugcaggagaacuacugccggaacccccgcggggaggagggcggccccuggugcuucacguccaacccggagguccgguacgaggugugcgacaucccccagugcagcgagguggagugcaugaccugcaacggggaguccuaccgcggccccauggaccacaccgagagcgggaagaccugccagcggugggaccagcagacgccccaccgccacaaguuccugccggagcgguaccccgacaagggcuucgacgacaacuacugccgcaaccccgacggcaagccccggccguggugcuacacccucgaccccgacacccccugggaguacugcgccaucaagaccugcgcgcacuccgccgucaacgagacggacgugcccauggagaccaccgagugcauccaggggcagggcgagggguaccgcggcaccagcaacacgaucuggaacgggaucccgugccagcggugggacucccaguacccccacaagcacgacaucacccccgagaacuucaagugcaaggaccugcgcgagaacuacugccggaaccccgacggcgccgagagcccguggugcuucaccaccgaccccaacauccgcgugggcuacugcagccagauccccaagugcgacgucuccagcgggcaggacugcuaccgcggcaacgggaagaacuacaugggcaaccuguccaagacgcggagcgggcucaccugcuccaugugggacaagaacauggaggaccugcaccgccacaucuucugggagcccgacgccagcaagcugaacaagaacuacugccggaacccggacgacgacgcgcacggccccuggugcuacaccggcaacccccucaucccgugggacuacugccccaucucccgcugcgagggggacaccacgcccaccaucgugaaccuggaccaccccgugaucagcugcgccaagaccaagcagcugcgggucgugaacggcaucccgacccagacgaccgugggguggauggucucccucaaguaccgcaacaagcacaucugcggcgggagccugaucaaggaguccugggugcugaccgcccggcagugcuuccccgcccgcaacaaggaccucaaggacuacgaggccuggcugggcauccacgacgugcacgagcggggcgaggagaagcgcaagcagauccugaacaucagccagcucgucuacgggcccgagggcuccgaccuggugcugcucaagcuggcgcggcccgccauccuggacaacuucgugagcaccaucgaccucccguccuacgggugcacgauccccgagaagaccaccugcagcaucuacggcuggggcuacaccgggcugaucaacgccgacggccugcuccgcgucgcccaccuguacaucauggggaacgagaagugcucccagcaccaccagggcaaggugacccugaacgagagcgagcucugcgccggggcggagaagaucggcuccggccccugcgagggggacuacggcgggccccugaucugcgagcagcacaagaugcggaugguccugggcgugaucgugccggggcgcggcugcgccauccccaaccggcccggcaucuucguccgcguggccuacuacgccaaguggauccacaaggugauccugacguacaagcucuga

SEQ ID NO: 5270 - RNA, 648 nt, Artificial Sequence
  derived and/or modified protein sequence (opt1) from Homo sapiens__NP_002119.1__HsHMGB1
augggcaagggggaccccaagaagccgcgcggcaagaugagcagcuacgccuucuucgugcagaccugccgggaggagcacaagaagaagcaccccgacgccagcgucaacuucuccgaguucagcaagaagugcuccgagcgcuggaagaccaugagcgcgaaggagaaggggaaguucgaggacauggccaaggccgacaaggcccgguacgagcgcgagaugaagacguacaucccgcccaagggcgagaccaagaagaaguucaaggaccccaacgcccccaagcggccgcccuccgcguucuuccuguucugcagcgaguaccgccccaagaucaagggggagcaccccggccucuccaucggcgacguggccaagaagcugggggagauguggaacaacaccgccgccgacgacaagcagcccuacgagaagaaggcggccaagcugaaggagaaguacgagaaggacaucgccgccuaccgggccaagggcaagcccgacgcggccaagaaggggguggucaaggccgagaaguccaagaagaagaaggaggaggaggaggacgaggaggacgaggaggacgaggaggaggaggaggacgaggaggacgaggacgaggaggaggacgacgacgacgaguga

SEQ ID NO: 5271 - RNA, 645 nt, Artificial Sequence
  derived and/or modified protein sequence (opt1) from Mus musculus__NP_001273985.1__MmVEGFA
augaacuuccugcucagcugggugcacuggacccuggcccugcuccuguaccugcaccacgcgaaguggucgcaggccgccccgacgaccgagggcgagcagaagagccacgaggucaucaaguucauggacguguaccagcggagcuacugccgccccaucgagacccucguggacaucuuccaggaguacccggacgagaucgaguacaucuucaagccgucgugcgucccccugaugcggugcgcggggugcugcaacgacgaggcccuggagugcgugccgacgagcgagagcaacaucaccaugcagaucaugcggaucaagccgcaccagucgcagcacaucggcgagaugagcuuccuccagcacagccgcugcgagugccggcccaagaaggaccggaccaagccggagaagaagucggugcgcggcaaggggaagggccagaagcggaagcggaagaagagccgcuucaagagcuggucgguccacugcgagccgugcagcgagcggcggaagcaccuguucgugcaggacccccagacgugcaagugcagcugcaagaacaccgacucgcgcugcaaggcccggcagcuggagcucaacgagcggaccugccgcugcgacaagccgcggcgguga

SEQ ID NO: 5272 - RNA, 630 nt, Artificial Sequence
  derived and/or modified protein sequence (opt2) from Homo sapiens__NP_061986.1__HsFGF21(L126R,P199G,A208E)
auggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcgccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggcggcucccagggccgcucccccuccuacgaguccuga

SEQ ID NO: 5273 - RNA, 2187 nt, Artificial Sequence
  derived and/or modified protein sequence (opt2) from Mus musculus__NP_001276387.1__MmHGF
augauguggggcaccaagcuccuccccguccuccuccuccagcacguccuccuccaccuccuccuccuccacgucgccauccccuacgccgagggccagaagaagcgccgcaacacccuccacgaguucaagaaguccgccaagaccacccucaccaaggaggacccccuccucaagaucaagaccaagaaggucaacuccgccgacgagugcgccaaccgcugcauccgcaaccgcggcuucaccuucaccugcaaggccuucgucuucgacaagucccgcaagcgcugcuacugguaccccuucaacuccauguccuccggcgucaagaagggcuucggccacgaguucgaccucuacgagaacaaggacuacauccgcaacugcaucaucggcaagggcggcuccuacaagggcaccgucuccaucaccaaguccggcaucaagugccagcccuggaacuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccccauggaccacaccgaguccggcaagaccugccagcgcugggaccagcagaccccccaccgccacaaguuccuccccgagcgcuaccccgacaagggcuucgacgacaacuacugccgcaaccccgacggcaagccccgccccuggugcuacacccucgaccccgacacccccugggaguacugcgccaucaagaccugcgcccacuccgccgucaacgagaccgacguccccauggagaccaccgagugcauccagggccagggcgagggcuaccgcggcaccuccaacaccaucuggaacggcauccccugccagcgcugggacucccaguacccccacaagcacgacaucacccccgagaacuucaagugcaaggaccuccgcgagaacuacugccgcaaccccgacggcgccgagucccccuggugcuucaccaccgaccccaacauccgcgucggcuacugcucccagauccccaagugcgacgucuccuccggccaggacugcuaccgcggcaacggcaagaacuacaugggcaaccucuccaagacccgcuccggccucaccugcuccaugugggacaagaacauggaggaccuccaccgccacaucuucugggagcccgacgccuccaagcucaacaagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccagaccaccgucggcuggauggucucccucaaguaccgcaacaagcacaucugcggcggcucccucaucaaggaguccuggguccucaccgcccgccagugcuuccccgcccgcaacaaggaccucaaggacuacgaggccuggcucggcauccacgacguccacgagcgcggcgaggagaagcgcaagcagauccucaacaucucccagcucgucuacggccccgagggcuccgaccucguccuccucaagcucgcccgccccgccauccucgacaacuucgucuccaccaucgaccuccccuccuacggcugcaccauccccgagaagaccaccugcuccaucuacggcuggggcuacaccggccucaucaacgccgacggccuccuccgcgucgcccaccucuacaucaugggcaacgagaagugcucccagcaccaccagggcaaggucacccucaacgaguccgagcucugcgccggcgccgagaagaucggcuccggccccugcgagggcgacuacggcggcccccucaucugcgagcagcacaagaugcgcaugguccucggcgucaucguccccggccgcggcugcgccauccccaaccgccccggcaucuucguccgcgucgccuacuacgccaaguggauccacaaggucauccucaccuacaagcucuga

SEQ ID NO: 5274 - RNA, 648 nt, Artificial Sequence
  derived and/or modified protein sequence (opt2) from Homo sapiens__NP_002119.1__HsHMGB1
augggcaagggcgaccccaagaagccccgcggcaagauguccuccuacgccuucuucguccagaccugccgcgaggagcacaagaagaagcaccccgacgccuccgucaacuucuccgaguucuccaagaagugcuccgagcgcuggaagaccauguccgccaaggagaagggcaaguucgaggacauggccaaggccgacaaggcccgcuacgagcgcgagaugaagaccuacaucccccccaagggcgagaccaagaagaaguucaaggaccccaacgcccccaagcgcccccccuccgccuucuuccucuucugcuccgaguaccgccccaagaucaagggcgagcaccccggccucuccaucggcgacgucgccaagaagcucggcgagauguggaacaacaccgccgccgacgacaagcagcccuacgagaagaaggccgccaagcucaaggagaaguacgagaaggacaucgccgccuaccgcgccaagggcaagcccgacgccgccaagaagggcgucgucaaggccgagaaguccaagaagaagaaggaggaggaggaggacgaggaggacgaggaggacgaggaggaggaggaggacgaggaggacgaggacgaggaggaggacgacgacgacgaguga

SEQ ID NO: 5275 - RNA, 645 nt, Artificial Sequence
  derived and/or modified protein sequence (opt2) from Mus musculus__NP_001273985.1__MmVEGFA
augaacuuccuccucuccuggguccacuggacccucgcccuccuccucuaccuccaccacgccaaguggucccaggccgcccccaccaccgagggcgagcagaagucccacgaggucaucaaguucauggacgucuaccagcgcuccuacugccgccccaucgagacccucgucgacaucuuccaggaguaccccgacgagaucgaguacaucuucaagcccuccugcgucccccucaugcgcugcgccggcugcugcaacgacgaggcccucgagugcguccccaccuccgaguccaacaucaccaugcagaucaugcgcaucaagccccaccagucccagcacaucggcgagauguccuuccuccagcacucccgcugcgagugccgccccaagaaggaccgcaccaagcccgagaagaaguccguccgcggcaagggcaagggccagaagcgcaagcgcaagaagucccgcuucaaguccugguccguccacugcgagcccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcuga

SEQ ID NO: 5276 - RNA, 630 nt, Artificial Sequence
  derived and/or modified protein sequence (opt3) from Homo sapiens__NP_061986.1__HsFGF21(L126R,P199G,A208E)
auggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugagagauuacuggaagauggguauaacgucuaccagagcgaggcacacggacuucccuugcaucugccugguaauaaaaguccacacagggaccccgccccucggggcccagcucgcuuucuaccgcuccccgggcugccuccagcccuucccgaaccuccaggcauucuggcgccccagccgccugaugugggauccucugaccccuugagcaugguuggugggucccagggaagaucaccaaguuaugagagcuga

SEQ ID NO: 5277 - RNA, 2187 nt, Artificial Sequence
  derived and/or modified protein sequence (opt3) from Mus musculus__NP_001276387.1__MmHGF
augauguggggcaccaagcugcuccccgugcuucuguugcagcacgucuuacugcaucuacuccugcuucacguugccaucccuuacgcugaggggcaaaagaagagaaggaacacacugcaugaguucaaaaagagcgcaaaaacuacguugaccaaggaggacccacuccugaagauuaaaacaaagaaaguaaauuccgccgaugaaugcgcgaaccgguguauacgcaaucgaggauuuacuuuuaccugcaaggcuuucguguucgacaaaucucguaagagauguuauugguacccguuuaacucaaugaguagcggugugaagaaaggcuucgggcacgaguuugaucuguaugaaaauaaggacuacaucaggaacugcauuaucggaaaaggcgguuccuauaaggggacagucucuauuaccaaaucgggaaucaagugucagcccuggaacucaaugauaccucaugagcacagcuuccucccaaguuccuaccggggcaaagauuuacaggagaauuauugccgcaaucccagaggcgaagaagggggaccuugguguuuuacuucuaacccagaagugagguacgagguuugcgacaucccccaguguagcgagguggaaugcaugacauguaauggugaguccuaccggggcccuauggaucacaccgaaucagggaagacgugccaacgcugggaccagcagacuccacaucgacacaaguuccugccggagagauaucccgauaaaggauuugacgauaacuacugcaggaauccugacggcaagccacggcccugguguuauacccuugauccugacacaccaugggaauacugcgccauuaaaacuugugcacauagugccgucaacgagaccgacgugcccauggagacaaccgaaugcauccagggucaaggggagggauaucguggcacgagcaauacuauuuggaacggcaucccgugucagcgcugggauucucaguacccucacaagcacgacauaacacccgaaaacuucaaaugcaaggauuugagagagaauuauuguaggaacccagacggggcugaauccccuuggugcuuuaccacugaucccaauauucggguaggauacuguucacagaucccaaagugcgacguuagcaguggucaagauuguuaccgaggcaacgggaaaaauuauaugggaaaccugucuaagacacgcuccggccuaaccugcagcaugugggacaaaaauauggaggaucuccauagacacauuuucugggagcccgacgcaucgaagcugaacaaaaauuacugcaggaacccugaugacgacgcccaugguccaugguguuauacggggaauccgcuuauccccugggauuacugcccuaucucucggugugaaggcgacaccacaccaacuauugugaaccuggaucaccccgucauauccugcgcuaagaccaagcaguugcgcguggugaauggaaucccuacacagacuaccgucggcuggaugguuucacucaaauauagaaacaagcauauuugugggggaagucugaucaaagagagcuggguguuaacagccaggcaaugcuucccagcgcguaauaaggaccugaaagauuacgaagcauggcucgguauacacgacguacacgagcggggcgaagagaagcgaaagcagauucuuaacaucucccagcugguguaugggcccgagggaucugauuugguccuacugaaacucgccagaccggcuauccuggacaacuuugugagcaccauugaucuuccuucauacggcuguacuaucccagaaaagacgacaugcaguauuuacgguuggggguauaccggccugauaaaugccgacggauugcucaggguugcacaucuguacaucaugggcaacgagaaauguucccagcaccaucaagggaaggugacuuuaaaugaaagcgagcugugcgcuggagccgagaaaauugguucuggccccugugaaggggauuauggaggcccucuaaucugcgagcagcacaagaugcgcaugguccucggugugaucguacccgggcggggcugcgcgauuccaaacagaccuggaauauucguuaggguggccuacuaugcaaaauggauccacaaggucauucugaccuacaaacuuuga

SEQ ID NO: 5278 - RNA, 648 nt, Artificial Sequence
  derived and/or modified protein sequence (opt3) from Homo sapiens__NP_002119.1__HsHMGB1
augggcaagggggaccccaaaaagccuagaggaaaaaugagcuccuacgccuucuuugugcagaccugcagggaggaacacaagaaaaagcauccagaugcuucugucaacuucucagaguuuaguaagaaauguagcgaacgguggaagacaauguccgcaaaagagaaggguaaauucgaagacauggccaaggcggauaaggcucgcuaugagcgagagaugaaaacuuacaucccgcccaagggcgaaacgaaaaagaaauuuaaggacccuaaugccccaaaacgucccccuucugcauucuuucuguucugcucggaguauagaccaaagauuaagggggaacaccccggacucucaauaggcgauguugccaagaaacuuggugagauguggaacaauaccgcugcagacgauaaacaaccuuacgagaagaaagccgcuaagcugaaggaaaaauaugagaaggacaucgccgcguacagggcaaaagggaagccagaugccgcuaaaaagggagugguaaaggccgagaaaagcaagaaaaagaaagaagaagaggaggacgaagaggaugaagaggacgaagaggaggaagaggaugaagaggacgaagacgaggaggaagaugacgaugacgaguga

SEQ ID NO: 5279 - RNA, 645 nt, Artificial Sequence
  derived and/or modified protein sequence (opt3) from Mus musculus__NP_001273985.1__MmVEGFA
augaacuuccugcucagcugggugcacuggacccuugcccuguuguuauaccugcaucacgcuaaguggucccaggcagcccccacaacugagggcgaacaaaaaucucaugaggucaucaaguuuauggacguuuaucagagaucauacugcaggccuauugaaacgcuaguggauauauuccaggaguauccagacgaaaucgaguacauuuuuaaaccgaguuguguaccccucaugcggugcgcgggguguugcaaugaugaggcucuggaaugugugccuaccagcgaguccaacaucacaaugcagauuaugcgcaucaagccacaccaaucucagcauauaggagaaaugucguuccuucagcacucacgaugcgagugucgucccaaaaaggacagaacuaagccugagaaaaagagcgucagggguaaaggcaaggggcagaaacggaagcgcaagaaaaguagauuuaaguccuggucugugcacugcgaaccauguagcgagaggcggaaacaucuguucguucaagauccccagaccugcaaguguuccugcaaaaauacagacucacgcugcaaggcccgacaguuggaacucaacgagagaaccuguaggugcgauaaaccucggcguuga

SEQ ID NO: 5280 - RNA, 630 nt, Artificial Sequence
  derived and/or modified protein sequence (opt4) from Homo sapiens__NP_061986.1__HsFGF21(L126R,P199G,A208E)
auggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagagacugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggcggcagccagggcagaagccccagcuacgagagcuga

SEQ ID NO: 5281 - RNA, 2187 nt, Artificial Sequence
  derived and/or modified protein sequence (opt4) from Mus musculus__NP_001276387.1__MmHGF
augauguggggcaccaagcugcugcccgugcugcugcugcagcacgugcugcugcaccugcugcugcugcacguggccauccccuacgccgagggccagaagaagagaagaaacacccugcacgaguucaagaagagcgccaagaccacccugaccaaggaggacccccugcugaagaucaagaccaagaaggugaacagcgccgacgagugcgccaacagaugcaucagaaacagaggcuucaccuucaccugcaaggccuucguguucgacaagagcagaaagagaugcuacugguaccccuucaacagcaugagcagcggcgugaagaagggcuucggccacgaguucgaccuguacgagaacaaggacuacaucagaaacugcaucaucggcaagggcggcagcuacaagggcaccgugagcaucaccaagagcggcaucaagugccagcccuggaacagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccccauggaccacaccgagagcggcaagaccugccagagaugggaccagcagaccccccacagacacaaguuccugcccgagagauaccccgacaagggcuucgacgacaacuacugcagaaaccccgacggcaagcccagacccuggugcuacacccuggaccccgacacccccugggaguacugcgccaucaagaccugcgcccacagcgccgugaacgagaccgacgugcccauggagaccaccgagugcauccagggccagggcgagggcuacagaggcaccagcaacaccaucuggaacggcauccccugccagagaugggacagccaguacccccacaagcacgacaucacccccgagaacuucaagugcaaggaccugagagagaacuacugcagaaaccccgacggcgccgagagccccuggugcuucaccaccgaccccaacaucagagugggcuacugcagccagauccccaagugcgacgugagcagcggccaggacugcuacagaggcaacggcaagaacuacaugggcaaccugagcaagaccagaagcggccugaccugcagcaugugggacaagaacauggaggaccugcacagacacaucuucugggagcccgacgccagcaagcugaacaagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccacccagaccaccgugggcuggauggugagccugaaguacagaaacaagcacaucugcggcggcagccugaucaaggagagcugggugcugaccgccagacagugcuuccccgccagaaacaaggaccugaaggacuacgaggccuggcugggcauccacgacgugcacgagagaggcgaggagaagagaaagcagauccugaacaucagccagcugguguacggccccgagggcagcgaccuggugcugcugaagcuggccagacccgccauccuggacaacuucgugagcaccaucgaccugcccagcuacggcugcaccauccccgagaagaccaccugcagcaucuacggcuggggcuacaccggccugaucaacgccgacggccugcugagaguggcccaccuguacaucaugggcaacgagaagugcagccagcaccaccagggcaaggugacccugaacgagagcgagcugugcgccggcgccgagaagaucggcagcggccccugcgagggcgacuacggcggcccccugaucugcgagcagcacaagaugagaauggugcugggcgugaucgugcccggcagaggcugcgccauccccaacagacccggcaucuucgugagaguggccuacuacgccaaguggauccacaaggugauccugaccuacaagcuguga

SEQ ID NO: 5282 - RNA, 648 nt, Artificial Sequence
  derived and/or modified protein sequence (opt4) from Homo sapiens__NP_002119.1__HsHMGB1
augggcaagggcgaccccaagaagcccagaggcaagaugagcagcuacgccuucuucgugcagaccugcagagaggagcacaagaagaagcaccccgacgccagcgugaacuucagcgaguucagcaagaagugcagcgagagauggaagaccaugagcgccaaggagaagggcaaguucgaggacauggccaaggccgacaaggccagauacgagagagagaugaagaccuacaucccccccaagggcgagaccaagaagaaguucaaggaccccaacgcccccaagagaccccccagcgccuucuuccuguucugcagcgaguacagacccaagaucaagggcgagcaccccggccugagcaucggcgacguggccaagaagcugggcgagauguggaacaacaccgccgccgacgacaagcagcccuacgagaagaaggccgccaagcugaaggagaaguacgagaaggacaucgccgccuacagagccaagggcaagcccgacgccgccaagaagggcguggugaaggccgagaagagcaagaagaagaaggaggaggaggaggacgaggaggacgaggaggacgaggaggaggaggaggacgaggaggacgaggacgaggaggaggacgacgacgacgaguga

SEQ ID NO: 5283 - RNA, 645 nt, Artificial Sequence
  derived and/or modified protein sequence (opt4) from Mus musculus__NP_001273985.1__MmVEGFA
augaacuuccugcugagcugggugcacuggacccuggcccugcugcuguaccugcaccacgccaaguggagccaggccgcccccaccaccgagggcgagcagaagagccacgaggugaucaaguucauggacguguaccagagaagcuacugcagacccaucgagacccugguggacaucuuccaggaguaccccgacgagaucgaguacaucuucaagcccagcugcgugccccugaugagaugcgccggcugcugcaacgacgaggcccuggagugcgugcccaccagcgagagcaacaucaccaugcagaucaugagaaucaagccccaccagagccagcacaucggcgagaugagcuuccugcagcacagcagaugcgagugcagacccaagaaggacagaaccaagcccgagaagaagagcgugagaggcaagggcaagggccagaagagaaagagaaagaagagcagauucaagagcuggagcgugcacugcgagcccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagauga

SEQ ID NO: 5284 - RNA, 630 nt, Artificial Sequence
  derived and/or modified protein sequence (opt5) from Homo sapiens__NP_061986.1__HsFGF21(L126R,P199G,A208E)
auggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagagacugcuugaagauggcuauaacguguaccaguccgaggcccacgggcugccccuccaucugccuggaaauaaaagcccgcaccgggaccccgcgccucgcggccccgccagauuucugccucuccccgggcugccgccugcccuucccgaaccucccggaauccuggcuccccagccuccggauguugggucuuccgacccccucagcauggugggcgggucucagggacgguccccuagcuaugagucuuga

SEQ ID NO: 5285 - RNA, 2187 nt, Artificial Sequence
  derived and/or modified protein sequence (opt5) from Mus musculus__NP_001276387.1__MmHGF
augauguggggcaccaagcugcuccccgugcugcuucugcagcacguccuccugcaucuucugcuccugcacguugccaucccuuacgcugaggggcagaaaaagagacggaacacacugcaugaguucaaaaagagcgccaaaacgacccucacaaaggaagacccgcugcuuaagauuaaaaccaagaaagucaauuccgcggaugaaugcgcuaaccgcuguaucagaaaucggggauuuacauuuaccugcaaggccuucguguucgacaaaucucgcaagagauguuauugguaccccuuuaacagcauguccucuggcgugaagaaaggguucggacacgaguuugaucuguaugaaaauaaggacuacauucggaacugcaucauuggcaaagggggaagcuauaagggcacaguguccaucaccaaaucuggcaucaagugucaaccuuggaauagcaugauuccccaugagcacuccuuccucccuagcucuuaccgcgggaaagaucugcaggagaacuauugcagaaauccccggggagaagagggcgggccuugguguuuuacguccaacccggaaguucgcuacgaggugugcgacaucccccaguguagcgaggucgaaugcaugaccuguaauggagagucuuacagaggcccuauggaucacacagaauccgggaagaccugccaacggugggaccagcagacaccccaucgccacaaguuccuuccugagagauaucccgauaaaggauuugacgauaacuacugccggaauccggacggcaagccucgccccugguguuauacccuggauccugacacgcccugggaauacugcgccauuaaaacaugugcucauagcgccgugaacgagaccgacguucccauggagacaaccgaaugcauccagggccaaggggagggauauagaggcaccucuaauacaauuuggaacgggaucccuugucagcggugggauucccaguacccgcacaagcacgacauuacgcccgaaaacuucaaaugcaaggaucucagagagaauuauugucgcaacccugacggagcugaaagccccuggugcuuuaccacagauccuaauauccgggugggcuacuguucccagauccccaagugcgacgucucuagcgggcaagauuguuacagaggaaacggcaaaaauuauaugggcaaccuguccaagacccgcagcgggcugacaugcucuaugugggacaaaaauauggaggaucuccaucggcacauuuucugggagccggacgccuccaagcugaacaaaaauuacugcagaaacccugaugacgacgcgcauggacccugguguuauaccggcaauccucuuauccccugggauuacugcccuauuagccgcugugaaggggacacgacacccaccaucgugaaccuggaucacccggugauuucuugcgccaagaccaagcagcuccgggucguuaauggaaucccuacacagaccacagugggcuggauggugagccugaaauauagaaacaagcauaucugugggggcucccuuauuaaagagucuuggguccugacggcucgccaaugcuuccccgcccggaauaaggaccucaaagauuacgaggcuuggcugggaauccacgacgugcacgaaagaggcgaagagaagcgcaagcagauucugaacaucagccagcucguuuaugggcccgagggauccgaucuggugcuucugaaacucgcccggccugcgauucuggacaacuuugucagcaccaucgaucuuccgucuuacggcuguacaauccccgaaaagaccacaugcuccauuuacggguggggauauaccggccugaucaaugccgacgggcuccugagaguggcucaucuguacauuaugggcaacgagaaauguagccagcaccaucaaggaaagguuacgcucaaugaaucugagcugugcgccggcgcugagaaaaucggguccggaccuugugaaggcgauuaugggggaccccuuauuugcgagcagcacaagaugcggauggugcugggcgucaucgugccugggcgcggcugcgccauucccaacagaccuggaaucuucguccggguggccuacuaugcuaaauggauccacaagguuauucucaccuacaagcuguga

SEQ ID NO: 5286 - RNA, 648 nt, Artificial Sequence
  derived and/or modified protein sequence (opt5) from Homo sapiens__NP_002119.1__HsHMGB1
augggcaagggggaccccaaaaagccuagaggaaaaaugagcuccuacgccuucuuugugcagaccugccgggaggaacacaagaaaaagcauccggaugcuucugucaacuucagcgaguuuuccaagaaauguucugaacgcuggaagacaaugagcgccaaagagaagggcaaauucgaagacauggcgaaggcugauaaggccagauaugagcgggagaugaaaacguacauucccccuaagggggaaaccaaaaagaaauuuaaggaccccaaugccccuaaaagacccccuuccgcuuucuuucuguucugcucugaguaucgcccgaagaucaagggagaacaccccggccucagcaucggggauguugccaaaaagcugggagagauguggaacaauacagcugccgacgauaaacaaccuuacgagaagaaagcggccaaacuuaaggaaaaguaugagaaggacauugcugccuaccgggcuaaaggcaagcccgaugccgcgaaaaagggcguggugaaggccgaaaaauccaagaaaaagaaagaggaagaggaggacgaagaggaugaagaggacgaagaggaggaagaggaugaagaggacgaagacgaggaggaagaugacgaugacgaguga

SEQ ID NO: 5287 - RNA, 645 nt, Artificial Sequence
  derived and/or modified protein sequence (opt5) from Mus musculus__NP_001273985.1__MmVEGFA
augaacuuccugcucagcugggugcacuggacccuggcccuucugcucuaccugcaucacgcuaaguggucccaggccgcgcccacaacggagggcgaacaaaaaucucaugaggucaucaaguuuauggacguuuaucagagaagcuacugccggccuauugaaacccuuguggauaucuuccaggaguauccggacgaaauugaguacaucuuuaaacccuccugugugccucugaugcgcugcgcuggguguugcaaugaugaggcccucgaauguguccccacaucugagagcaacauuaccaugcagaucaugagaaucaagccucaccaaucccagcauauuggagaaaugucuuuccugcagcacagccggugcgagugucgccccaaaaaggacagaacaaagccugagaaaaaguccgugcggggcaaagggaagggacagaaacgcaagagaaagaaaagccgguuuaagucuugguccguucacugcgaaccguguagcgagcgcagaaaacaucuguucgugcaagauccccagaccugcaaguguucuugcaaaaauacagacucccggugcaaggcccgccagcucgaacugaacgagagaaccugucggugcgauaaaccucgcagauga

SEQ ID NO: 5288 - RNA, 630 nt, Artificial Sequence
  derived and/or modified protein sequence (opt6) from Homo sapiens__NP_061986.1__HsFGF21(L126R,P199G,A208E)
auggauucagaugaaacaggauuugaacacucaggauuaugggucucaguuuuagcaggacuauuacuaggagcaugucaagcacauccaauaccagacucaagcccauuauuacaauuuggaggacaaguaagacaaagauauuuauauacagaugacgcacaacaaacagaagcacauuuagaaauaagagaagacggcacaguaggaggagcagcagaucaaucaccagaaucacuauuacaauuaaaagcauuaaaaccaggaguaauacaaauauuaggaguaaaaacaucaagauucuuaugccaaagaccugacggagcauuauaugguucacuacacuuugacccagaagcauguucauucagagaaagacuacuagaagacggauauaauguuuaccaaucugaagcacauggauuaccacuacacuuaccaggaaauaaaucaccacaccgagacccagcaccacgaggaccagcaagauuccuaccacuaccaggauuaccaccagcauuaccagaaccaccaggaauacuagcuccacaaccaccagacguaggauccucagauccauuaucaaugguaggaggaucucaagguagaagucccucauacgaaucauaa

SEQ ID NO: 5289 - RNA, 2187 nt, Artificial Sequence
  derived and/or modified protein sequence (opt6) from Mus musculus__NP_001276387.1__MmHGF
augauguggggaacaaaacuauuaccaguauuauuauuacaacaugucuuauuacauuuacuucuacuacauguugcaauacccuaugccgaaggacaaaagaaaagaagaaacacucuucacgaguucaagaaaagcgcaaaaacaacauuaacaaaagaagacccacuacuaaaaauaaaaacaaagaaaguaaacucagcagaugaaugugccaacagauguauuagaaaccgggguuuuacuuuuacaugcaaagccuucguauucgauaaaucaaggaaaagaugcuacugguauccauucaauucaaugucauccggagucaagaaaggauucggccaugaauuugaccuauacgaaaauaaagauuauaucagaaacuguauaauaggaaaaggugguucauacaaaggaacaguaucaauaacaaaaagcgguauuaaaugucaacccuggaacucuaugauuccucaugaacauucauuuuuaccaucaucauacagagguaaagacuuacaagaaaauuacugcagaaauccaaggggagaagaaggcggaccauggugcuuuacaucaaaucccgaaguaagauaugaaguaugcgacauaccacaauguagugaaguugaauguaugacauguaauggagaaagcuacagagguccaauggaucauacagaaucaggaaaaacaugccaaagaugggaucaacaaacaccgcauagacauaaauuuuuaccagaaagauauccagauaaaggauucgaugacaauuacuguaggaaucccgacggaaaaccacgaccauggugcuauacacuagacccugauacuccaugggaauauugcgcuauaaaaacuugugcacauucagcaguaaacgaaaccgacguaccaauggaaaccacugaauguauacaagggcaaggagaaggauacagaggaacaucaaauacaauauggaacggaauacccugucaaagaugggauagccaauauccacauaaacacgacauaaccccagaaaacuuuaaauguaaagaucuaagagaaaauuacugcagaaaucccgauggcgcagaaucaccauggugcuucacaacagaucccaacauaagagucggauauugcucccagauuccuaaaugugauguaagcuccgggcaagacugcuaccgaggcaacgguaaaaauuacaugggaaacuuaaguaaaacaagaucaggauuaacaugcaguaugugggauaaaaauauggaggacuuacauagacauauauucugggaaccagaugcaucaaaacuuaacaaaaauuauugcagaaacccagacgacgaugcacacggaccaugguguuauacaggaaauccacuuauaccaugggacuauuguccaauaucacgaugcgaaggagauacaacaccaacaauaguaaacuuagaucauccaguaauaaguugcgcaaaaacuaaacaauuacgaguuguuaacggaauaccaacacaaacuacagucggauggaugguuucauuaaaauauagaaacaaacacauaugcggaggaucccuuauaaaagaauccuggguauuaacagcaagacaauguuuuccagccagaaauaaagaucucaaagacuacgaagcaugguuaggcauacacgauguacaugaacgaggagaagaaaaacgaaaacaaauauuaaauauaagccagcuaguuuauggaccagaaggaucggacuuaguacuauuaaaacuugcaagaccagcaauccuagacaauuuugucucaacaaucgacuuacccucauauggaugcacuauuccggagaaaacaacaugcuccauauacggauggggauauacaggauugauaaaugcagauggauuacuaagaguagcacaucuauacauaaugggaaaugaaaaauguucacaacaccaucaaggaaaaguaacacuaaacgaaagcgaauuaugugcaggcgcagagaaaauaggcaguggaccaugugaaggagauuacgguggaccacuaauaugcgaacaacauaaaaugagaaugguccuaggaguaauaguccccggaagaggaugugcaauaccaaaucgaccgggcauauuuguaagaguagcauacuacgcaaaauggauacacaaaguaauacuaacauacaaacuauaa

SEQ ID NO: 5290 - RNA, 648 nt, Artificial Sequence
  derived and/or modified protein sequence (opt6) from Homo sapiens__NP_002119.1__HsHMGB1
augggaaaaggagacccaaaaaaaccaagaggaaaaaugucaagcuacgcauucuucguacaaacaugcagagaagaacacaaaaaaaaacacccagacgcaagcguaaacuucagcgaauucagcaaaaaauguucagaaagauggaaaacaaugagcgcaaaagaaaaaggaaaauucgaagacauggcaaaagcagacaaagcaagauacgaaagagaaaugaaaacauacauaccaccaaaaggagaaacaaaaaaaaaauucaaagacccaaacgcgccaaaaagaccaccaucagcauucuucuuauucugcagugaauacagaccaaaaauaaaaggagaacacccaggacuaaguauaggagacguagcaaaaaaacuaggagaaauguggaacaacacagcagcagacgacaaacaaccauacgaaaaaaaagcagcaaaacuaaaagaaaaauacgaaaaagacauagcggcauacagagcaaaaggaaaaccagacgcagcaaaaaaaggaguaguaaaagcagaaaaaaguaaaaaaaaaaaagaagaagaagaagacgaagaagacgaagaagacgaagaagaagaagaagacgaagaagacgaagacgaagaagaagacgacgacgacgaauaa

SEQ ID NO: 5291 - RNA, 645 nt, Artificial Sequence
  derived and/or modified protein sequence (opt6) from Mus musculus__NP_001273985.1__MmVEGFA
augaacuuccuauuaagcuggguacacuggacacuagcacuacuacuauacuuacaccacgccaaauggagccaagcagcaccaacaacagaaggagaacaaaaaucacacgaaguaauaaaauucauggacguauaccaaagaucauacuguagaccaauagaaacacuaguagacauauuccaagaauacccagacgaaauagaauacauauucaaaccaucaugcguaccacuaaugagaugcgcaggaugcugcaacgacgaagcacuagaaugcguaccaacaucagaaucaaacauaacaaugcaaauaaugagaauaaaaccacaccaaagucaacacauaggagaaaugaguuuccuacaacacucaagaugcgaaugcagaccaaaaaaagacagaacaaaaccagaaaaaaaaucaguaagaggaaaaggaaaaggccaaaaaagaaaaagaaaaaaaucaagauucaaaagcuggucaguacacugugaaccauguucagaaagaagaaaacaccuauucguacaagacccacaaacaugcaaaugcaguugcaaaaacacagacucaagaugcaaagcaagacaacuagaauuaaaugaacgaacaugcagaugcgacaaaccaagaagauaa

SEQ ID NO: 5292 - RNA, 630 nt, Artificial Sequence
  derived and/or modified protein sequence (opt7) from Homo sapiens__NP_061986.1__HsFGF21(L126R,P199G,A208E)
auggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagaggcugcuggaagauggguauaacguguaccagagugaggcccacggcuugccccuccaucugccagguaauaaaagcccgcaccgggaccccgcaccacgcgggcccgccagguuucugccacuccccggccugccgcccgccuugccagaacccccaggcauccuggcaccccagccaccggaugugggguccagcgacccccucaguauggucgguggcucccaggggcggagcccauccuaugagaguuga

SEQ ID NO: 5293 - RNA, 2187 nt, Artificial Sequence
  derived and/or modified protein sequence (opt7) from Mus musculus__NP_001276387.1__MmHGF
augauguggggcaccaagcugcuccccgugcuguugcugcagcacguccuccugcauuugcugcuccugcacguggccaucccauacgcagaggggcagaaaaagaggcggaacacucugcaugaguucaaaaagagcgccaaaaccacgcucacuaaggaggacccgcuguugaagauuaaaaccaagaaaguaaauuccgcggaugaaugcgccaaccgcuguaucaggaaucgggguuuuaccuucacuugcaaggcauuuguguucgacaaaagucgcaagagguguuauugguaccccuuuaacagcauguccaguggcgucaaaaagggguucggccacgaguuugaucuguaugaaaauaaggacuacauucggaacugcaucauugguaaagggggcagcuauaagggcaccguguccaucacgaaaagcgggaucaagugucaaccauggaacuccaugauuccccaugagcacaguuuccucccaagcuccuaccgcgguaaagaucugcaggagaauuauugcaggaauccccggggcgaagaagggggcccaugguguuuuacuagcaacccggaagugcgcuacgaggucugcgacaucccccaguguagugagguggaaugcaugaccugcaauggugaguccuacagggggccaauggaucacacugaaagcggcaagaccugucaacggugggaccagcagacuccccaucgccacaaguuccugccagagagguaucccgauaaaggcuuugacgauaacuacugccggaauccggacgggaagccccgcccaugguguuauacguuggaucccgacacuccaugggaauacugcgccauuaaaaccugugcacauuccgccguaaacgagacugacgugcccauggagaccaccgaaugcauccagggucaaggcgagggguauaggggcaccaguaauacgauuuggaacgguaucccaugucagcggugggauagccaguacccgcacaagcacgacauuacccccgaaaacuucaaaugcaaggaucuccgcgagaauuauuguaggaacccagacggcgcggaaucccccuggugcuucacuaccgauccaaauauccgggucggguacugcagccagauccccaagugugacgugaguuccggccaagauugcuacagggggaacgguaaaaauuauaugggcaaccugagcaagacccgcagugggcugacuuguuccaugugggacaaaaauauggaggaucuccaucggcacaucuuuugggagccggacgccagcaagcugaacaaaaauuacugcaggaacccagaugacgacgcacauggccccugguguuauacggguaaucccuugauuccaugggauuacugccccauuagccgcugugaaggcgacaccacuccaaccaucgugaaccuggaucacccggucauuuccugcgccaagaccaagcagcuccgggugguaaaugggauccccacucagacgaccgugggcuggauggucagucugaaauauaggaacaagcauaucugugggggcagccugauuaaagaguccuggguguugacugcccgccaaugcuucccagcacggaauaaggaccucaaagauuacgaagccuggcuggguauccacgacgugcacgagaggggcgaagagaagcggaaacagauucugaacaucagccagcucgucuaugggcccgaggguagugaucugguguugcugaagcucgcgcgcccagccauucuggacaacuuuguauccaccaucgaucugcccagcuacggcuguacuaucccggaaaagaccacgugcuccauuuacggguggggcuauaccggguugaucaaugcagacggccuccugaggguggcccaucuguacauuauggguaacgagaaaugcagucagcaccaucaagggaaggucacucucaaugaaagcgagcugugugcaggcgccgagaaaaucggcuccgggccaugcgaaggugauuauggcgggcccuugauuugugagcagcacaagaugcggauggugcugggcgucaucgugccaggucgcgggugcgccauucccaacaggccgggcaucuucgugcggguagcguacuaugcaaaauggauccacaaggugauucucaccuacaagcuguga

SEQ ID NO: 5294 - RNA, 648 nt, Artificial Sequence
  derived and/or modified protein sequence (opt7) from Homo sapiens__NP_002119.1__HsHMGB1
augggcaagggggaccccaaaaagccaagggguaaaaugagcuccuacgccuucuuugugcagaccugccgggaggaacacaagaaaaagcauccggaugcaagugucaacuucagcgaguuuuccaagaaauguagugaacgcuggaagacuaugagcgccaaagagaagggcaaauucgaagacauggcgaaggccgauaaagcaagguaugagcgggagaugaagaccuacauucccccaaagggggaaacgaaaaagaaauuuaaggaccccaaugccccaaaaaggcccccauccgcauucuuucuguucugcagcgaguaucgcccgaagaucaagggcgaacaccccggucucuccaucggggauguggccaaaaagcugggcgagauguggaacaauacugcggccgacgauaaacaaccauacgagaagaaagcagccaaguugaaggaaaaauaugagaaggacauugccgcauaccgggccaaaggcaagcccgaugcggccaaaaaggggguagugaaggcagagaaaaguaagaaaaagaaagaagaagaggaggacgaagaggaugaagaggacgaagaggaggaagaggaugaagaggacgaagacgaggaggaagaugacgaugacgaguga

SEQ ID NO: 5295 - RNA, 645 nt, Artificial Sequence
  derived and/or modified protein sequence (opt7) from Mus musculus__NP_001273985.1__MmVEGFA
augaacuuccugcucagcugggugcacuggacccuggccuugcugcucuaccugcaucacgcaaaguggucccaggccgcgcccacuaccgagggcgaacagaaaagucaugaggucaucaaguuuauggacguguaucaaaggagcuacugccggccaauugaaacguugguagauaucuuccaggaguauccggacgaaauugaguacaucuuuaaacccuccugugugccacugaugcgcugcgccggguguugcaaugaugaggcacucgaauguguccccaccagugagagcaacauuacuaugcagaucaugaggaucaagccacaccaaucccagcauauuggugaaaugagcuuccugcagcacucccggugcgagugucgccccaaaaaggacaggaccaagccagagaaaaagagugugcggggcaaagggaagggccagaaacgcaagaggaaaaagagccgguuuaaguccuggagcgugcacugcgaaccguguagugagcgcaggaaacaucuguucguccaagauccccagacuugcaagugcuccuguaaaaauaccgacagccggugcaaggcccgccagcucgaacugaacgagaggacgugucggugcgauaaaccaaggcgcuga

SEQ ID NO: 5296 - RNA, 630 nt, Artificial Sequence
  derived and/or modified protein sequence (opt8) from Homo sapiens__NP_061986.1__HsFGF21(L126R,P199G,A208E)
auggacucugacgaaaccggcuucgaacacuccggacucugggucuccguccucgccggccuccuccuaggcgccugccaagcccaccccauccccgacucauccccacuccuacaauucggcggccaaguccgucaacgcuaccucuauaccgaugacgcccaacaaaccgaagcccaccucgaaauccgcgaagacggaaccgucggcggcgccgcugaccaaucacccgaaucccuccuccaacucaaagcacucaaacccggcguaauccaaauccucggcguaaaaaccucacgauuucuaugucaaagacccgacggagcccuauacggcucucuacacuucgacccagaagcaugcuccuuccgcgaacgacuccucgaagacggauacaacgucuaccaaucagaagcccacggccuaccccuccaccuccccggcaacaaaucuccccaccgcgaccccgcaccccgcggccccgcccgcuuccucccccuccccggccuacccccagcccuacccgaaccacccggcauacucgcaccccaaccacccgacgucggcuccuccgacccccuauccauggucggcggcucccaaggccgcucccccucauacgaaucuuaa

SEQ ID NO: 5297 - RNA, 1993 nt, Artificial Sequence
  derived and/or modified protein sequence (opt8) from Mus musculus__NP_001276387.1__MmHGF
augauguggggcacgaaacugcucccaguauugcucuugcaacacguccuacuccaccuucuacugcuacacgucgcuauacccuaugccgaaggacaaaagaaacgucgcaacacccuacacgaauuuaagaaaagcgccaagaccacacucacuaaagaagauccccuacucaaaauaaagaccaaaaaggugaacucggcugacgaaugcgccaaccgaugcauccgaaacagaggcuucacuuuuaccugcaaagccuucguuuucgacaagagccgaaaacgaugcuacugguacccauucaacagcauguccuccgggguaaagaaaggcuucggacaugaguucgaucuauacgaaaauaaagacuacauaagaaacugcauaaucggcaaaggaggguccuacaaaggcacagucagcaucacaaagucagggaucaaaugccaacccuggaacuccaugauaccacacgagcacaguuuccucccuaguagcuaccgaggaaaagaccuccaggagaacuacugccgcaacccccgcggggaagaaggcggaccuuggugcuucacaagcaaccccgagguccgcuacgaggucugcgacaucccccaaugcagcgaagucgagugcaugaccuguaacggagaaucauaccgaggcccaauggaucacaccgaauccggaaaaacaugccaacgaugggaccaacaaacaccgcaccgacacaaguuccuccccgaacgguaccccgacaaaggauucgacgacaacuacugccgcaaccccgacggaaaaccacgaccauggugcuacacgcucgacccggacacccccugggaauacugcgccaucaaaaccugcgcacacucagcggugaacgaaaccgauguaccaauggaaacaaccgaaugcauccaaggacaaggagagggcuacaggggcacgucaaauaccaucuggaacggcauaccaugccagcgcugggacagucaguacccccacaaacacgacauaacccccgaaaacuucaaaugcaaagaccucagagaaaacuacugccgcaaccccgacggcgccgaaucccccugguguuucacaaccgacccaaacauccgcgugggcuacugcucacaaauccccaagugcgacguaucaagcggccaagacugcuaucgcgggaacggcaaaaacuacaugggaaaccucucaaagaccagaagcggccuaacaugcucaaugugggacaaaaacauggaggaccuccaccggcacaucuuuugggaacccgacgcuuccaaacucaacaaaaacuacugccgaaaccccgacgacgaugcacacggcccauggugcuacacaggcaacccccugauacccugggacuacugccccaucuccagaugcgagggcgacacaacaccgaccaucguaaaucucgaccaccccguaaucuccugcgccaaaacaaaacaacuaagggucgugaacggaauccccacccaaacaacagugggcuggauggucagccucaaauacagaaacaagcacaucugcggcggcucccucaucaaggaaagcuggguacuaacagccaggcaaugcuuccccgccagaaauaaagaucuaaaagacuacgaagccuggcuaggcauccaugacguccacgaacgcggcgaggagaaacgaaaacaaauucucaacaucucucaacucgucuauggaccagaagggagcgaccucguucuucugaaacucgcccggcccgcaaucuuagacaacuucgucagcacaaucgaccuccccucauacggaugcaccaucccagaaaagacaaccugcagcauauacggauggggcuacaccggccugaucaacgcagacggccuucucagagucgcccaucucuacaucaugggaaacgaaaaaugcagccaacaccaccaaggcaaaguaacgcucaacgaauccgaacucugcgccggagcag

SEQ ID NO: 5298 - RNA, 648 nt, Artificial Sequence
  derived and/or modified protein sequence (opt8) from Homo sapiens__NP_002119.1__HsHMGB1
auggggaaaggggacccgaaaaagccaagaggaaagaugucgagcuaugccuuuuucgugcaaacgugcagggaagaacacaagaaaaagcacccggacgcgagcgugaacuuuagcgaguucucgaaaaagugcucagaaagguggaagaccaugagcgcgaaagaaaaagggaaauuugaagauauggcaaaagcggacaaggcaagguacgagcgagaaaugaagacauauaucccgccaaagggcgagacaaagaagaaauucaaagacccgaacgcgcccaagcgcccgccaucggccuuuuuccuauucugcagcgaguacaggcccaagauaaagggcgagcacccaggauugagcauaggcgaugucgcgaaaaagcuaggggaaauguggaacaacacggccgcggacgauaaacagccguaugaaaagaaagcggccaagcucaaggaaaaguacgagaaagauaucgcggccuauagagcgaaaggaaaaccggacgcggccaagaaagggguagugaaagcggaaaagagcaagaaaaagaaagaggaagaggaagaugaagaggacgaggaagacgaagaggaagaggaagaugaagaggacgaggacgaggaagaggacgaugacgaugaauag

SEQ ID NO: 5299 - RNA, 645 nt, Artificial Sequence
  derived and/or modified protein sequence (opt8) from Mus musculus__NP_001273985.1__MmVEGFA
augaacuuccuccucuccuggguccacuggacccucgcccuccuccucuaccuucaccacgcaaaauggucccaagccgcccccaccaccgaaggagaacaaaaaucccacgaagucauaaaauucauggacguauaccaacgaucauacugccgacccaucgaaacccuagucgacaucuuccaagaauacccagacgaaaucgaauacauauucaaacccuccugcguaccccucaugcgcugcgccggcugcugcaacgacgaagcccuagaaugcgucccaacaucagaaucaaacaucaccaugcaaaucaugcgcaucaaaccacaccaaucccaacacauaggcgaaauguccuuccuccaacacucacgcugcgaaugccgccccaaaaaagaccgaaccaaacccgaaaaaaaaucaguccgaggcaaaggaaaaggccaaaaacgcaagcgcaaaaaaucccgcuucaaauccugguccguccacugcgaacccugcuccgaacgccgaaaacaccucuucguccaagacccacaaaccugcaaaugcuccugcaaaaacaccgacuccagaugcaaagcacgccaacucgaacucaacgaaagaaccugccgcugcgacaaaccccgccgcuaa

SEQ ID NO: 5300 - RNA, 630 nt, Artificial Sequence
  derived and/or modified protein sequence (opt9) from Homo sapiens__NP_061986.1__HsFGF21(L126R,P199G,A208E)
auggacuccgacgaaaccggauucgaacacucaggccucugggucucaguccucgccggccuccuccucggagccugccaagcccacccaauccccgacuccucaccacuccuccaauucggcggccaaguccgacaacgauaccucuacaccgacgacgcccaacaaaccgaagcccaccucgaaauccgcgaagacggcacaguaggaggcgccgccgaccaaucacccgaaucccuacuccaacuaaaagcacucaaacccggcgucauccaaauacucggcgucaaaaccucaagauuccucugccaacgccccgacggcgcccucuacggcucccuccacuucgaccccgaagccugcuccuuccgcgaacgccuccucgaagacggcuacaacgucuaccaauccgaagcccacggccucccccuccaccucccaggcaacaaauccccacaccgcgaccccgcaccccgcggcccagcccgcuuccucccccuccccggacuacccccugcccuacccgaaccaccaggcauccucgcaccccaaccacccgacgucggcuccuccgacccccucucaaugguaggcggcucacaaggccgaucccccuccuacgaauccuaa

SEQ ID NO: 5301 - RNA, 2187 nt, Artificial Sequence
  derived and/or modified protein sequence (opt9) from Mus musculus__NP_001276387.1__MmHGF
augauguggggcacaaaacuccuuccgguacugcugcuacaacacgugcuucuccaccuccuucuacuccacgucgcaauccccuaugcagaagggcagaaaaagcgacgcaacacacuccacgaguucaagaaaucggccaaaacaacccuaaccaaagaggacccccuccucaaaaucaaaaccaagaaaguaaacuccgccgacgagugcgccaacagaugcauccgcaaccggggcuucaccuucacaugcaaagccuucguguucgauaaaagccgcaaacgaugcuacugguacccauucaacuccaugagcucgggaguuaagaaaggcuuuggccacgaauuugaccuauacgagaauaaagacuacauaagaaacugcaucaucgguaaaggcggcucauacaaagggaccguauccaucacaaaaagcggaauaaaaugccaaccguggaacucuaugauaccccacgaacacucauuccuaccauccucauaccgcggcaaagaccuacaagagaacuacugccgaaacccccgaggagaagaagggggaccauggugcuucaccucaaacccagagguacgguacgaagucugcgacaucccacaaugcagcgaaguagagugcaugaccuguaacggagaguccuaccggggaccaauggaccauaccgaaucgggaaaaacuugccaacgaugggaucaacaaacaccccaucgucacaaauuccuaccggaacgauacccagacaaaggauucgacgacaacuacugcagaaaucccgacgguaaacccagaccuuggugcuacacccuagaccccgacaccccaugggaauacugcgccauaaagaccugcgcacacucugccgucaacgagaccgacguccccauggaaacaaccgaaugcauacaggggcagggagagggcuaccgcggcaccagcaacaccaucuggaacgguauacccugccagcgaugggacagccaauacccccacaagcacgacauaaccccugagaacuucaagugcaaagaccuacgcgaaaacuacugccgaaacccagacggcgccgaaucaccaugguguuucacaacagacccaaacauccgcgucggcuacugcucccaaauacccaaaugcgacgucaguuccggacaagacugcuaccgaggcaacggaaagaacuacaugggaaaccucuccaaaacccguagcgguuuaacaugcuccaugugggacaagaacauggaagaccuacacagacauauauucugggaacccgacgcaagcaaacucaacaaaaauuacugccgcaaccccgacgacgaugcccauggccccuggugcuacaccggcaacccccugauccccugggacuacuguccaauaagccgaugcgagggggacaccaccccuaccaucgucaaccuggaccaccccgucaucuccugcgcaaaaaccaaacagcuccgaguagugaacggcaucccaacccagacaacggucggauggauggucucacuaaaauaccgaaacaaacacauaugcgguggaucccucaucaaagaaagcugggucuuaaccgcccgccaaugcuuccccgcacgaaacaaagaccuaaaagacuacgaagcauggcuaggcauccacgacguacacgaacgaggcgaagaaaaacgaaagcaaauccucaacaucucacaguuagucuacggaccagaagguucagaccucgugcuccuaaaguuagcccgccccgccauacuagacaacuucgucagcaccaucgaccuaccaucauacggaugcaccauaccagagaaaaccacaugcaguaucuacggcuggggcuacacgggccucaucaacgccgacggccuccuacgcguagcccaccucuauaucaugggcaacgaaaaaugcucacaacaccaccaagggaaaguaacacugaacgaauccgagcucugcgccggcgccgagaaaaucggauccggccccugcgaaggagacuacgggggaccacuaauaugcgaacagcacaagaugcgaaugguccucggagucaucguacccggccgaggcugcgcaauacccaaucgccccggcauauucguucgcguagccuacuacgcuaaauggauccacaaagucauacucaccuacaaacuauaa

SEQ ID NO: 5302 - RNA, 648 nt, Artificial Sequence
  derived and/or modified protein sequence (opt9) from Homo sapiens__NP_002119.1__HsHMGB1
auggggaaaggggacccgaagaaaccaaggggaaaaaugucgagcuaugccuucuucgugcaaacgugcagggaggaacacaagaaaaagcacccagacgcgagcgugaacuuuagcgaguucucgaaaaagugcucggaaagguggaagacaaugagcgcgaaagagaaagggaaauuugaagauauggcgaaagcggacaaggccagguacgagcgagagaugaagaccuauaucccgcccaagggcgagacaaagaagaaauucaaagacccgaacgcgccaaagcgcccgcccucggcauuuuucuuguucuguagcgaguacaggccaaagaucaagggcgagcacccaggcuugagcauaggcgaugucgccaaaaagcucggggaaauguggaauaacacagcagcagacgauaaacagcccuaugaaaagaaagcggcaaagcucaaggaaaaguacgagaaagauaucgcggccuaucgcgcgaaagggaaaccggacgcggcaaagaaaggggucgugaaagcggaaaagagcaagaaaaagaaagaggaagaggaagaugaagaggacgaggaagaugaagaggaagaggaagaugaagaggacgaggacgaagaagaggacgaugacgaugaauag

SEQ ID NO: 5303 - RNA, 645 nt, Artificial Sequence
  derived and/or modified protein sequence (opt9) from Mus musculus__NP_001273985.1__MmVEGFA
augaacuuccuccucuccuggguccacuggacacucgcccuccuccuauaccuacaccacgccaaauggagccaagccgcccccacaaccgaaggcgaacaaaaaucccacgaagucaucaaauucauggacgucuaccaacgcuccuacugccgccccaucgaaacccucgucgacaucuuccaagaauaccccgacgaaaucgaauacaucuucaaacccuccugcgucccccucaugcgcugcgccggcugcugcaacgacgaagcccucgaaugcguccccaccucagaaucaaacauaacaaugcaaaucaugcgcaucaaaccccaccaaucccaacacaucggagaaauguccuuccuccaacacucacgcugcgaaugccgcccaaaaaaagaccgcaccaaacccgaaaaaaaauccguacgcggcaaaggcaaaggccaaaaacgcaaacgcaaaaaaucccgcuucaaaucauggucaguccacugcgaacccugcagcgaacgacgcaaacaccucuucguccaagacccacaaacaugcaaaugcuccugcaaaaacacagacucgcgcugcaaagcccgccaacucgaacuaaacgaacgcaccugccgcugcgacaaaccccgacgcuag

SEQ ID NO: 5304 - RNA, 630 nt, Artificial Sequence
  derived and/or modified protein sequence (opt11) from Homo sapiens__NP_061986.1__HsFGF21(L126R,P199G,A208E)
auggacuccgacgaaaccggcuucgaacacuccggccucugggucuccguccucgccggccuccuccuaggcgcaugccaagcccaccccauacccgacuccucaccccuccuccaauucggcggccaaguccgccaacgcuaccuauacaccgacgacgcccaacaaacagaagcccaccucgaaauccgagaagacggcacagucggcggcgccgccgaccaaagccccgaaucccuccuccaacucaaagcccucaaacccggcgucauccaaauccucggcgucaaaacaucccgcuuccuaugccaacgccccgacggcgcccucuacggcucacuccacuucgaccccgaagccugcuccuuccgcgaacgccuccucgaagacggcuacaacgucuaccaauccgaagcccacggccuaccccuacaccuccccggcaacaaauccccucaccgcgaccccgcaccccgcggccccgcccgcuuccuaccccuccccggccucccccccgcccuacccgaaccccccggcauccucgccccccaacccccagacgucggcuccucugacccccucuccauggucggcggcucccaaggccgcucacccuccuacgaauccuaa

SEQ ID NO: 5305 - RNA, 2187 nt, Artificial Sequence
  derived and/or modified protein sequence (opt11) from Mus musculus__NP_001276387.1__MmHGF
augauguggggaacaaaauuacuaccaguccuacuacuccaacacguccuacuccaccuacuacuacuccacgucgcaauccccuacgccgaaggacagaaaaagcgaagaaacacacuacacgaauuuaagaaaucagccaaaaccacccuaaccaaagaagacccccuacugaaaaucaaaacuaagaaagucaacuccgcagaugagugcgcaaaccgaugcauacgcaaccgcggcuucacauucacuugcaaagccuucguuuucgacaaaucacgaaaacgcugcuacugguaccccuuuaacucgaugagcucaggcgugaagaaaggcuucggccaugaguucgaccuauacgaaaauaaagauuacauacguaacugcaucaucggaaaagguggcagcuacaaaggcacugucucaauaacgaaaaguggcaucaaaugccaacccuggaacuccaugaucccucacgaacacucauuccuccccuccagcuacagagggaaagaccuacaagaaaacuacugccguaauccaagaggagaagaaggcggaccuuggugcuucaccuccaaccccgaaguaagauacgaagugugcgacauaccacaaugcuccgaagucgaaugcaugaccugcaacggcgaauccuaccgaggacccauggaccacaccgaaucagguaagaccugccaacgcugggaccaacaaacaccccacagacacaaauuccucccugaacgcuaccccgacaaaggcuucgacgacaacuacugcaggaacccagacgguaaaccccgacccugguguuacacccucgacccagauacacccugggaauacugcgccauaaaaacaugcgcacacuccgccgucaacgagacagacguccccauggaaaccaccgagugcauacaaggacaaggggaaggauacagaggaacaucaaacaccauuuggaacggcauacccugccaaagaugggacucccaguauccccacaaacacgacaucacaccagaaaacuucaaaugcaaggaccuacgagaaaacuacugccgcaacccagacggagcugaaucccccuggugcuucacaacagacccgaauauccgcgucggauacuguucgcaaaucccaaagugcgacgucagcucaggacaagacugcuacagaggaaacggcaagaacuauaugggcaaccuuucgaaaacacgcagcggccuaaccugcuccaugugggacaagaacauggaagaccuccaccggcacauauucugggaacccgacgcaaguaaacuuaacaaaaacuacugucgcaauccggacgacgacgcccacggcccuuggugcuacaccgguaacccccuaaucccgugggacuacugccccauaucccgaugcgaaggagauacaacacccaccaucgugaaccuagaccaccccgucaucucaugcgcuaaaacgaaacagcuccgagucgucaacggcaucccaacgcaaacgaccgucggauggauggucucccugaaauaccgcaacaaacacauaugcggcggaagccuaauaaaagaaagcuggguccuuacagcccggcaaugcuucccagcccguaacaaagaccucaaagacuacgaagccuggcucggcauccacgacguacaugaacgaggggaagaaaaacgcaaacaaauacucaacaucucccagcugguauacggcccggaaggaagcgaccucguccucuugaaacuagccagacccgccauacuagacaacuucgucagcaccaucgaccuccccucauacggcugcaccaucccagaaaagacaaccugcucaaucuacggcuggggcuacaccggacuaaucaacgccgacggacuccugcgggucgcccauuuguacaucaugggaaacgaaaaaugcucccaacaccaccaaggcaaagucacccugaacgaauccgaacucugcgcaggcgccgagaaaaucggaucaggacccugcgaaggggacuacgggggcccccucaucugcgagcaacauaaaaugcguauggugcuaggcgugaucguccccggacgcggaugcgccaucccgaaccgccccgggaucuucguccgcgucgccuacuacgccaaauggauacauaaagucauucucaccuacaagcuguaa

SEQ ID NO: 5306 - RNA, 648 nt, Artificial Sequence
  derived and/or modified protein sequence (opt11) from Homo sapiens__NP_002119.1__HsHMGB1
auggggaaaggggacccgaaaaagccgaggggaaagaugucgagcuaugccuucuucgugcaaacgugcagggaggaacacaagaaaaagcacccggacgcgagcgugaacuucagcgaguucucgaaaaagugcucggaaagguggaagaccaugagcgcgaaagagaaagggaaauuugaagauauggcgaaagcggacaaggcaagguacgagcgagagaugaagacauauauaccaccaaagggcgagaccaagaaaaaguucaaggacccgaacgcgcccaagcgcccgccaucggccuuuuucuuguucuguagcgaguacaggcccaagaucaagggagagcacccgggcuugagcauaggcgacgucgcgaaaaagcucggggaaauguggaauaacacggccgcggacgauaaacagccauaugaaaagaaagcggccaagcuaaaggaaaaguacgagaaagauaucgcggcauaucgcgcgaaagggaaaccggacgcggccaagaaaggagucguaaaagcggaaaagagcaagaaaaagaaagaggaagaggaagaugaagaggacgaggaagaugaagaggaagaggaagaugaagaggacgaggacgaggaagaggacgaugacgaugaauag

SEQ ID NO: 5307 - RNA, 645 nt, Artificial Sequence
  derived and/or modified protein sequence (opt11) from Mus musculus__NP_001273985.1__MmVEGFA
augaacuuccuccuauccuggguccacuggacacucgcccuccuccucuaccuccaccacgccaaauggucccaagcagcacccaccacagaaggcgaacaaaaaucccacgaagucaucaaguucauggacgucuaccaacgcucauacugccgccccaucgaaacacucguagacaucuuccaagaauaccccgacgaaaucgaauacaucuucaaacccuccugcgucccacuaaugcgcugcgccggaugcugcaacgacgaagcccucgaaugcgucccaaccuccgaauccaacaucaccaugcaaaucaugcgcaucaaaccccaccaaucccaacacaucggcgaaauguccuuccuccaacacucccgcugcgaaugccgccccaaaaaagaccgcaccaaacccgaaaaaaaaucaguccgcggcaaaggcaaaggucaaaaacgaaaacgcaaaaaaucacgcuucaaauccugguccguccacugcgaacccugcucagaacgacgcaaacaccucuucguccaagacccccaaaccugcaaaugcucaugcaaaaacaccgacucccgaugcaaagcccgccaacucgaacucaacgaacgaaccugccgcugcgacaaaccccgacgcuaa

SEQ ID NO: 5308 - RNA, 630 nt, Artificial Sequence
  derived and/or modified protein sequence (opt12) from Homo sapiens__NP_061986.1__HsFGF21(L126R,P199G,A208E)
auggacucugacgaaacagguuucgaacacucaggacuaugggucucaguauuagcaggacuauuauuaggagcaugucaagcacauccaauaccagacucaucaccacuacuacaauucggcggacaaguaagacaaagauacuuauacacagacgaugcacaacaaacagaagcacauuuagaaauaagagaagauggcacaguaggcggagcagcagaccaaucaccagaaucacuauuacaauuaaaagcauuaaaaccaggaguaauacaaauauuaggaguaaaaacaucaagauucuuaugucaaagaccugacggagcacuauacggaucacuacacuuugacccagaagcaugcucauuuagagaaagauuauuagaagacggauacaauguauaucaaucagaagcacacggauuaccauuacacuuacccggaaauaaaucaccacauagagacccagcaccaagaggaccugcaagauuucuaccucuaccaggacuaccaccagcacuaccugaaccaccaggaauauuagcaccacaaccaccagacguaggauccucagaccccuuaucaaugguaggcggaucacaaggaagaucaccaucauaugaaucauaa

SEQ ID NO: 5309 - RNA, 2187 nt, Artificial Sequence
  derived and/or modified protein sequence (opt12) from Mus musculus__NP_001276387.1__MmHGF
augauguggggaacuaaauuacuaccaguucuauuacuucaacacguccuauuacauuuauuacuauuacacguugcaauaccauaugcagaaggacaaaaaaaaagaaggaacaccuuacacgaauuuaaaaaaucggcaaaaacaacccucacaaaggaagacccacuauuaaaaaucaaaacaaaaaaagugaauagugcagacgaaugugcaaauagaugcauaagaaacagaggauuuacauucacuuguaaagcauuuguauuugauaaaucaaggaaaagguguuauugguauccuuuuaacucaaugucuaguggaguaaaaaaaggauucggacaugaauuugaccuauaugaaaauaaagacuauauaagaaauugcauaauaggaaaagguggaucauauaaagggacaguuagcauaaccaaaucaggcauaaaaugucaaccauggaauucaaugauaccacaugaacauuccuuucuaccuaguaguuaucguggaaaagauuuacaagaaaauuauuguagaaacccaagaggagaagaaggagggccauggugcuuuacaagcaacccagaagucagauaugaaguaugugacauaccacaauguucagaaguagaauguaugacaugcaauggagaaucguauagagguccaauggaccauacagaaucaggaaaaacaugucaaagaugggaucaacaaaccccacaucgacauaaauucuuaccagaacgauauccagacaaaggguucgacgauaauuauugcagaaauccagaugggaaaccaagacccugguguuacacucuagaccccgauacaccaugggaauauugugcaauaaaaacaugcgcacacucagcaguaaaugagacugaugucccaauggaaacuacagaaugcauucaaggacaaggugaagguuaccgaggcacaaguaauacuauauggaaugggauaccaugucaaagaugggacagucaauacccacauaaacaugauauaacgccagaaaauuuuaaauguaaagauuuaagagaaaauuauugcagaaauccugauggcgcggaaaguccauggugcuucacaacugauccuaacauaagaguugguuauugcagucaaauaccuaaaugcgauguaucauccggacaagauuguuauagggguaauggaaaaaauuauaugggcaauuuaucaaaaacacguaguggauuaacauguucaaugugggauaaaaauauggaagauuuacaucgacacauuuucugggaacccgaugcuaguaaauuaaacaaaaacuauugucgaaacccagaugaugaugcacauggaccauggugcuauacagguaacccacuuauaccaugggacuauuguccuauaucaagaugugaaggcgauacaacaccuacuauagucaauuuagaucauccuguaaucaguugcgcuaaaacaaaacaauuaagaguuguaaacggaauuccaacacaaacaacaguaggauggaugguaucacucaaauaccgaaauaaacacauaugcggagguucuuuaauaaaagaaagcuggguauuaaccgcaagacaaugcuucccggcaagaaauaaagauuuaaaagauuaugaagcaugguuaggaauacacgauguacacgaaaggggagaagaaaaaagaaaacaaauacuaaauauaucacaauuaguauacggcccagaagggagcgaucuaguucuucuaaaauuagccagaccagcaauauuagauaauuuuguaucuacuaucgaucuaccaucauauggauguacaauaccugagaaaacaacauguucaauauauggauggggauauacuggauuaauaaacgccgauggacuucuuagaguagcacacuuauauauaaugggaaacgaaaaaugcucacaacaucaucaaggaaaaguuacacuaaacgaaucagaacuaugugcuggcgcagaaaaaaucggaucaggcccaugcgaaggugauuacggcggaccacuuauaugugaacaacauaaaaugcgcaugguauuaggagucauaguucccggucggggcugugcgauaccaaacagaccaggcauauuuguccguguagccuacuaugcaaaauggauacauaaaguaauauuaacauauaaauuauaa

SEQ ID NO: 5310 - RNA, 648 nt, Artificial Sequence
  derived and/or modified protein sequence (opt12) from Homo sapiens__NP_002119.1__HsHMGB1
augggaaaaggagacccaaaaaaaccaagaggaaaaaugucaagcuacgcauucuucguacaaacaugcagagaagaacacaaaaaaaaacacccagacgcaagcguaaacuucagcgaauucagcaaaaaaugcucagaaagguggaaaacaaugagcgcaaaagagaaaggaaaauucgaagacauggcaaaagcagacaaagcaagauacgaaagagaaaugaaaacauacauaccaccaaaaggagaaacaaaaaaaaaauuuaaagacccaaacgcaccaaaaagaccaccaucagcauucuuccuauucugcagugaauacagaccaaaaauaaaaggagaacacccaggacuaagcauaggagacguagcaaaaaaauuaggagaaauguggaacaacacagcagcagacgacaaacaaccauacgaaaaaaaagcagcaaaauuaaaagaaaaauacgaaaaggacauagcagcauaucgagcaaaaggaaaaccagacgcagcaaaaaaaggaguaguaaaagcagaaaaaagcaaaaaaaaaaaagaagaagaagaagacgaagaagacgaagaagacgaagaagaagaagaagacgaagaagacgaagacgaagaagaagacgacgacgacgaauaa

SEQ ID NO: 5311 - RNA, 645 nt, Artificial Sequence
  derived and/or modified protein sequence (opt12) from Mus musculus__NP_001273985.1__MmVEGFA
augaacuuccuacuaucauggguacacuggacacuagcauuacuacuauacuuacaccacgcaaaauggucacaagcagcaccaacaacagaaggagaacaaaaaucacacgaaguaauaaaauucauggacguauaccaacgaucauacugcagaccaauagaaacacuaguagacauauuccaagaauacccagacgaaauagaauacauauucaaaccaucaugcguaccauuaaugagaugcgcaggaugcugcaacgacgaagcauuagaaugcguaccaacaucagaaucaaacauaacaaugcaaauaaugagaauaaaaccacaccaaucacaacacauaggagaaaugucauuccuacaacauucaagaugcgaaugcagaccaaaaaaagacagaacaaaaccagaaaaaaaaucaguaagaggaaaaggaaaaggacaaaaaagaaaaagaaaaaaaucaagauucaaaucauggucaguacacugcgaaccaugcucagaacgaagaaaacacuuauuuguacaagacccacaaacaugcaaaugcucaugcaaaaacacagacucaagaugcaaagcaagacaacuagaacuaaaugaaagaacaugcagaugugacaaaccaagacgauaa

SEQ ID NO: 5312 - RNA, 630 nt, Artificial Sequence
  derived and/or modified protein sequence (opt13) from Homo sapiens__NP_061986.1__HsFGF21(L126R,P199G,A208E)
auggacucagacgaaacaggauuugaacacucaggacuauggguaucaguacuagcaggauuauuacuaggagccugccaagcacacccaauaccagacucaucaccauuauuacaauucggaggacaaguuagacaaagauaucuauauacagaugacgcacaacaaacagaagcacacuuagaaauaagagaagacggaacaguaggaggagcagcagaccaaucaccagaaucccuacuacaauuaaaagcacuaaaaccaggaguaauacaaauauuaggaguaaaaacaucaagauuccuaugccaaagaccagacggagcacuauacggcucacuacacuuugacccagaagcaugcucauucagagaaagacuacuagaagacggauauaauguauaucaaucagaagcacacggacuaccuuuacauuuaccaggaaacaaaucaccacacagagacccagcaccaagaggcccagcacgcuuuuuaccauuaccaggacuaccaccagcauuaccagaaccaccaggaauacuagcaccacaaccaccagauguuggaagcucagacccacuaucaaugguaggaggaucacaaggaagaucaccaucauaugaaucauaa

SEQ ID NO: 5313 - RNA, 2187 nt, Artificial Sequence
  derived and/or modified protein sequence (opt13) from Mus musculus__NP_001276387.1__MmHGF
augauguggggaacaaaacuuuuaccuguucuauuauuacaacacguccuguuacacuuauuauuacuacauguagccauaccuuacgcagaaggacaaaagaaacgaagaaacacacuucaugaauuuaagaaauccgcaaaaacaacauuaacaaaagaagauccauuauuaaaaauaaaaacaaagaaaguuaauucagcagaugaaugugcaaauagauguauaagaaacagaggauuuaccuuuacauguaaagcauuuguauucgacaaaucaaggaaacgauguuacugguauccauucaauaguaugaguucuggaguaaagaaaggauucggucaugaguucgaccuauaugaaaauaaagacuauauuagaaauuguauaaucggcaaaggugggucuuauaaaggcacuguuaguauaacaaaaucaggaauaaaaugucaaccauggaauagcaugauaccacacgaacacucauuucucccaucuucauacaggggcaaagaccuacaagaaaauuauuguagaaacccaaggggagaagaaggaggcccaugguguuuuacaucgaauccugaaguacgauaugaaguaugugacaucccccaaugcagugaaguagaauguaugacuuguaauggugaaucauaccgaggaccuauggaccauacagaaucaggaaaaacuugccaacgaugggaucaacaaaccccucaucgacacaaauuuuuaccagaacguuacccagauaaaggauuugacgauaauuacuguagaaauccagacgguaaaccucgacccugguguuacacucuugauccagauacaccaugggaauauugcgcaauaaaaacuugcgcacauucugcaguaaaugaaacagacguuccaauggaaacuaccgaauguauacaaggccaaggagaaggcuauagagguacaucaaauacaauauggaauggcauacccugccaaaggugggacucucaauauccacauaaacaugauauaacaccagaaaacuuuaaauguaaagauuuaagagaaaauuacuguagaaauccggauggagcagaaucucccugguguuucacuaccgauccuaacauaagaguaggauauuguagccaaauaccuaaaugugauguuagcucaggucaagacugcuacagagguaauggcaaaaauuacauggggaaucucaguaaaacacguaguggacucacauguucaaugugggauaaaaauauggaagaccugcacagacauauauucugggaaccugaugcuucaaaauuaaauaaaaauuauugcagaaauccagaugaugacgcucacggaccaugguguuacacugguaauccauuaauaccaugggauuauuguccaauaucaagaugcgaaggugauacaacuccaacaauaguaaaucuagaucauccaguaauauccugugcaaaaacaaaacaacuaagaguaguaaacggaauaccaacacaaacaacaguaggauggaugguuaguuuaaaauacagaaauaaacauauauguggaggauccuuaauaaaagaaucauggguauuaacugcaagacaauguuucccagcaaggaacaaagauuuaaaagauuacgaagcauggcuaggaauacaugauguucacgaaagaggagaagaaaaacguaaacaaauuuugaacauuucacaacuuguauacggcccagaaggaucugauuuaguauuauuaaaguuagcaagaccagcaauucucgauaauuucguaucaacgauagaucuccccaguuacggcuguacgauaccagaaaagacaacaugcaguauauacggauggggauauacaggacuaaucaacgcagauggacuuuuaagaguagcccacuuauauauaauggguaacgaaaaauguucacaacaucaucaaggaaaaguaacacuaaaugaaagcgaauuaugugcaggcgcagagaaaauaggaagcggaccuugugaaggcgauuacgguggaccacuaauaugugaacaacauaaaaugagaaugguauuaggaguaauaguuccaggacguggaugugccauaccaaaccgaccaggaauauuuguuaggguagccuacuacgcaaaauggauucacaaaguaauauuaacauauaaacuauaa

SEQ ID NO: 5314 - RNA, 648 nt, Artificial Sequence
  derived and/or modified protein sequence (opt13) from Homo sapiens__NP_002119.1__HsHMGB1
augggaaaaggagacccaaaaaaaccgagaggaaaaaugagcagcuacgcauuuuucguacaaacaugcagagaagaacacaaaaaaaaacacccagacgcaagcguaaacuuuagcgaauuuucaaaaaaaugcucagaaagauggaaaacaaugagcgcaaaagaaaaaggaaaauucgaagacauggcgaaagcagacaaagcaagauaugaaagagaaaugaaaacauacauaccaccaaaaggagaaaccaaaaaaaaauuuaaagacccaaacgcaccaaaaagaccaccaagcgcauucuuucuauucugcagugaauacagaccaaaaauaaaaggagaacacccaggauuaagcauaggagacguagcaaaaaaacuaggagaaauguggaacaacacagcagcagacgacaaacaaccauacgaaaaaaaagcagcaaaacuaaaagaaaaauacgaaaaagacauagcagcauauagagcaaaaggaaaaccagacgcagcaaaaaaaggaguaguaaaagcagaaaaaagcaaaaaaaaaaaagaagaagaagaagacgaagaagacgaagaagacgaagaagaagaagaagacgaagaagacgaagacgaagaagaagacgacgacgacgaauaa

SEQ ID NO: 5315 - RNA, 645 nt, Artificial Sequence
  derived and/or modified protein sequence (opt13) from Mus musculus__NP_001273985.1__MmVEGFA
augaacuuccuacuaucauggguacacuggacacuagcacuacuacuauacuuacaccacgcaaaauggagucaagcagcaccaacaacagaaggagaacaaaaaagccacgaaguaauaaaauucauggacguauaucaacgaucauacugcagaccaauagaaacacuaguagauaucuuccaagaauacccagacgaaauagaauacauauucaaaccaucaugcguaccauuaaugagaugcgcaggaugcugcaacgacgaagcacuagaaugcguaccaacaucagaaucaaacauaacaaugcaaauaaugagaauaaaaccccaccaaagccaacacauaggagaaaugucauuccuacaacacucaagaugcgaaugcagacccaaaaaagaccgaacaaaaccagaaaaaaaaucaguaagaggaaaaggaaaaggacaaaaaagaaaacgaaaaaaaucacgauucaaaucauggucaguacacugcgaaccaugcucugaaagaagaaaacaccuauucguacaagacccacaaacauguaaaugcagcugcaaaaacacagacucaagaugcaaagcaagacaacuagaauuaaacgaaagaacaugcagaugcgacaaaccacgaagauaa

SEQ ID NO: 5316 - RNA, 847 nt, Artificial Sequence
  mRNA product Design1 comprising derived and/or modified sequence from Homo sapiens__NP_061986.1__HsFGF21(L126R,P199G,A208E) (wt)
gggagaaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5317 - RNA, 847 nt, Artificial Sequence
  mRNA product Design1 comprising derived and/or modified sequence from Homo sapiens__NP_061986.1__HsFGF21(L126R,P199G,A208E) (wt)
gggagaaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5318 - RNA, 2404 nt, Artificial Sequence
  mRNA product Design1 comprising derived and/or modified sequence from Mus musculus__NP_001276387.1__MmHGF (wt)
gggagaaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaauuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauucccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcuuggcuuggcauccacgauguucaugagagaggcgaggagaagcgcaagcagaucuuaaacauuucccagcuggucuaugguccugaaggcucagacuugguuuuacugaagcuugcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5319 - RNA, 2404 nt, Artificial Sequence
  mRNA product Design1 comprising derived and/or modified sequence from Mus musculus__NP_001276387.1__MmHGF (wt)
gggagaaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaacuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauccccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcauggcuuggcauccacgauguucaugagagaggcgaggagaagcgcaagcagaucuuaaacauuucccagcuggucuaugguccugaaggcucagacuugguuuuacugaagcuggcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5320 - RNA, 865 nt, Artificial Sequence
  mRNA product Design1 comprising derived and/or modified sequence from Homo sapiens__NP_002119.1__HsHMGB1 (wt)
gggagaaagcuuaccaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaagcggacaaggcccguuaugaaagagaaaugaaaaccuauaucccucccaaaggggagacaaaaaagaaguucaaggaucccaaugcacccaagaggccuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaugaagaagaagaugaugaugaugaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5321 - RNA, 862 nt, Artificial Sequence
  mRNA product Design1 comprising derived and/or modified sequence from Mus musculus__NP_001273985.1__MmVEGFA (wt)
gggagaaagcuuaccaugaacuuucugcucucuugggugcacuggacccuggcuuuacugcuguaccuccaccaugccaaguggucccaggcugcacccacgacagaaggagagcagaagucccaugaagugaucaaguucauggaugucuaccagcgaagcuacugccguccgauugagacccugguggacaucuuccaggaguaccccgacgagauagaguacaucuucaagccguccugugugccgcugaugcgcugugcaggcugcuguaacgaugaagcccuggagugcgugcccacgucagagagcaacaucaccaugcagaucaugcggaucaaaccucaccaaagccagcacauaggagagaugagcuuccuacagcacagcagaugugaaugcagaccaaagaaagacagaacaaagccagaaaaaaaaucaguucgaggaaagggaaagggucaaaaacgaaagcgcaagaaaucccgguuuaaauccuggagcguucacugugagccuuguucagagcggagaaagcauuuguuuguccaagauccgcagacguguaaauguuccugcaaaaacacagacucgcguugcaaggcgaggcagcuugaguuaaacgaacguacuugcagaugugacaagccaaggcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5322 - RNA, 847 nt, Artificial Sequence
  mRNA product Design1 comprising derived and/or modified sequence from Homo sapiens__NP_061986.1__HsFGF21(L126R,P199G,A208E) (opt1)
gggagaaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcgccugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggggcucccagggccggagccccuccuacgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5323 - RNA, 2404 nt, Artificial Sequence
  mRNA product Design1 comprising derived and/or modified sequence from Mus musculus__NP_001276387.1__MmHGF (opt1)
gggagaaagcuuaccaugauguggggcaccaagcugcuccccgugcugcugcuccagcacguccugcugcaccuccugcugcuccacguggccaucccguacgccgaggggcagaagaagcgccggaacacccugcacgaguucaagaagagcgcgaagacgacccugaccaaggaggacccccuccugaagaucaagaccaagaaggugaacuccgccgacgagugcgccaaccgcugcauccggaaccgcggcuucacguucaccugcaaggccuucgucuucgacaagagccggaagcgcugcuacugguaccccuucaacuccaugagcuccggggugaagaagggcuucgggcacgaguucgaccuguacgagaacaaggacuacauccggaacugcaucaucggcaagggcgggagcuacaagggcaccguguccaucaccaagagcgggaucaagugccagcccuggaacuccaugaucccgcacgagcacagcuuccuccccuccagcuaccgcggcaaggaccugcaggagaacuacugccggaacccccgcggggaggagggcggccccuggugcuucacguccaacccggagguccgguacgaggugugcgacaucccccagugcagcgagguggagugcaugaccugcaacggggaguccuaccgcggccccauggaccacaccgagagcgggaagaccugccagcggugggaccagcagacgccccaccgccacaaguuccugccggagcgguaccccgacaagggcuucgacgacaacuacugccgcaaccccgacggcaagccccggccguggugcuacacccucgaccccgacacccccugggaguacugcgccaucaagaccugcgcgcacuccgccgucaacgagacggacgugcccauggagaccaccgagugcauccaggggcagggcgagggguaccgcggcaccagcaacacgaucuggaacgggaucccgugccagcggugggacucccaguacccccacaagcacgacaucacccccgagaacuucaagugcaaggaccugcgcgagaacuacugccggaaccccgacggcgccgagagcccguggugcuucaccaccgaccccaacauccgcgugggcuacugcagccagauccccaagugcgacgucuccagcgggcaggacugcuaccgcggcaacgggaagaacuacaugggcaaccuguccaagacgcggagcgggcucaccugcuccaugugggacaagaacauggaggaccugcaccgccacaucuucugggagcccgacgccagcaagcugaacaagaacuacugccggaacccggacgacgacgcgcacggccccuggugcuacaccggcaacccccucaucccgugggacuacugccccaucucccgcugcgagggggacaccacgcccaccaucgugaaccuggaccaccccgugaucagcugcgccaagaccaagcagcugcgggucgugaacggcaucccgacccagacgaccgugggguggauggucucccucaaguaccgcaacaagcacaucugcggcgggagccugaucaaggaguccugggugcugaccgcccggcagugcuuccccgcccgcaacaaggaccucaaggacuacgaggccuggcugggcauccacgacgugcacgagcggggcgaggagaagcgcaagcagauccugaacaucagccagcucgucuacgggcccgagggcuccgaccuggugcugcucaagcuggcgcggcccgccauccuggacaacuucgugagcaccaucgaccucccguccuacgggugcacgauccccgagaagaccaccugcagcaucuacggcuggggcuacaccgggcugaucaacgccgacggccugcuccgcgucgcccaccuguacaucauggggaacgagaagugcucccagcaccaccagggcaaggugacccugaacgagagcgagcucugcgccggggcggagaagaucggcuccggccccugcgagggggacuacggcgggccccugaucugcgagcagcacaagaugcggaugguccugggcgugaucgugccggggcgcggcugcgccauccccaaccggcccggcaucuucguccgcguggccuacuacgccaaguggauccacaaggugauccugacguacaagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5324 - RNA, 865 nt, Artificial Sequence
  mRNA product Design1 comprising derived and/or modified sequence from Homo sapiens__NP_002119.1__HsHMGB1 (opt1)
gggagaaagcuuaccaugggcaagggggaccccaagaagccgcgcggcaagaugagcagcuacgccuucuucgugcagaccugccgggaggagcacaagaagaagcaccccgacgccagcgucaacuucuccgaguucagcaagaagugcuccgagcgcuggaagaccaugagcgcgaaggagaaggggaaguucgaggacauggccaaggccgacaaggcccgguacgagcgcgagaugaagacguacaucccgcccaagggcgagaccaagaagaaguucaaggaccccaacgcccccaagcggccgcccuccgcguucuuccuguucugcagcgaguaccgccccaagaucaagggggagcaccccggccucuccaucggcgacguggccaagaagcugggggagauguggaacaacaccgccgccgacgacaagcagcccuacgagaagaaggcggccaagcugaaggagaaguacgagaaggacaucgccgccuaccgggccaagggcaagcccgacgcggccaagaaggggguggucaaggccgagaaguccaagaagaagaaggaggaggaggaggacgaggaggacgaggaggacgaggaggaggaggaggacgaggaggacgaggacgaggaggaggacgacgacgacgagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5325 - RNA, 862 nt, Artificial Sequence
  mRNA product Design1 comprising derived and/or modified sequence from Mus musculus__NP_001273985.1__MmVEGFA (opt1) R2139/R2140
gggagaaagcuuaccaugaacuuccugcucagcugggugcacuggacccuggcccugcuccuguaccugcaccacgcgaaguggucgcaggccgccccgacgaccgagggcgagcagaagagccacgaggucaucaaguucauggacguguaccagcggagcuacugccgccccaucgagacccucguggacaucuuccaggaguacccggacgagaucgaguacaucuucaagccgucgugcgucccccugaugcggugcgcggggugcugcaacgacgaggcccuggagugcgugccgacgagcgagagcaacaucaccaugcagaucaugcggaucaagccgcaccagucgcagcacaucggcgagaugagcuuccuccagcacagccgcugcgagugccggcccaagaaggaccggaccaagccggagaagaagucggugcgcggcaaggggaagggccagaagcggaagcggaagaagagccgcuucaagagcuggucgguccacugcgagccgugcagcgagcggcggaagcaccuguucgugcaggacccccagacgugcaagugcagcugcaagaacaccgacucgcgcugcaaggcccggcagcuggagcucaacgagcggaccugccgcugcgacaagccgcggcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5326 - RNA, 847 nt, Artificial Sequence
  mRNA product Design1 comprising derived and/or modified sequence from Homo sapiens__NP_061986.1__HsFGF21(L126R,P199G,A208E) (opt2)
gggagaaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcgccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggcggcucccagggccgcucccccuccuacgaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5327 - RNA, 2404 nt, Artificial Sequence
  mRNA product Design1 comprising derived and/or modified sequence from Mus musculus__NP_001276387.1__MmHGF (opt2)
gggagaaagcuuaccaugauguggggcaccaagcuccuccccguccuccuccuccagcacguccuccuccaccuccuccuccuccacgucgccauccccuacgccgagggccagaagaagcgccgcaacacccuccacgaguucaagaaguccgccaagaccacccucaccaaggaggacccccuccucaagaucaagaccaagaaggucaacuccgccgacgagugcgccaaccgcugcauccgcaaccgcggcuucaccuucaccugcaaggccuucgucuucgacaagucccgcaagcgcugcuacugguaccccuucaacuccauguccuccggcgucaagaagggcuucggccacgaguucgaccucuacgagaacaaggacuacauccgcaacugcaucaucggcaagggcggcuccuacaagggcaccgucuccaucaccaaguccggcaucaagugccagcccuggaacuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccccauggaccacaccgaguccggcaagaccugccagcgcugggaccagcagaccccccaccgccacaaguuccuccccgagcgcuaccccgacaagggcuucgacgacaacuacugccgcaaccccgacggcaagccccgccccuggugcuacacccucgaccccgacacccccugggaguacugcgccaucaagaccugcgcccacuccgccgucaacgagaccgacguccccauggagaccaccgagugcauccagggccagggcgagggcuaccgcggcaccuccaacaccaucuggaacggcauccccugccagcgcugggacucccaguacccccacaagcacgacaucacccccgagaacuucaagugcaaggaccuccgcgagaacuacugccgcaaccccgacggcgccgagucccccuggugcuucaccaccgaccccaacauccgcgucggcuacugcucccagauccccaagugcgacgucuccuccggccaggacugcuaccgcggcaacggcaagaacuacaugggcaaccucuccaagacccgcuccggccucaccugcuccaugugggacaagaacauggaggaccuccaccgccacaucuucugggagcccgacgccuccaagcucaacaagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccagaccaccgucggcuggauggucucccucaaguaccgcaacaagcacaucugcggcggcucccucaucaaggaguccuggguccucaccgcccgccagugcuuccccgcccgcaacaaggaccucaaggacuacgaggccuggcucggcauccacgacguccacgagcgcggcgaggagaagcgcaagcagauccucaacaucucccagcucgucuacggccccgagggcuccgaccucguccuccucaagcucgcccgccccgccauccucgacaacuucgucuccaccaucgaccuccccuccuacggcugcaccauccccgagaagaccaccugcuccaucuacggcuggggcuacaccggccucaucaacgccgacggccuccuccgcgucgcccaccucuacaucaugggcaacgagaagugcucccagcaccaccagggcaaggucacccucaacgaguccgagcucugcgccggcgccgagaagaucggcuccggccccugcgagggcgacuacggcggcccccucaucugcgagcagcacaagaugcgcaugguccucggcgucaucguccccggccgcggcugcgccauccccaaccgccccggcaucuucguccgcgucgccuacuacgccaaguggauccacaaggucauccucaccuacaagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5328 - RNA, 865 nt, Artificial Sequence
  mRNA product Design1 comprising derived and/or modified sequence from Homo sapiens__NP_002119.1__HsHMGB1 (opt2)
gggagaaagcuuaccaugggcaagggcgaccccaagaagccccgcggcaagauguccuccuacgccuucuucguccagaccugccgcgaggagcacaagaagaagcaccccgacgccuccgucaacuucuccgaguucuccaagaagugcuccgagcgcuggaagaccauguccgccaaggagaagggcaaguucgaggacauggccaaggccgacaaggcccgcuacgagcgcgagaugaagaccuacaucccccccaagggcgagaccaagaagaaguucaaggaccccaacgcccccaagcgcccccccuccgccuucuuccucuucugcuccgaguaccgccccaagaucaagggcgagcaccccggccucuccaucggcgacgucgccaagaagcucggcgagauguggaacaacaccgccgccgacgacaagcagcccuacgagaagaaggccgccaagcucaaggagaaguacgagaaggacaucgccgccuaccgcgccaagggcaagcccgacgccgccaagaagggcgucgucaaggccgagaaguccaagaagaagaaggaggaggaggaggacgaggaggacgaggaggacgaggaggaggaggaggacgaggaggacgaggacgaggaggaggacgacgacgacgagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5329 - RNA, 862 nt, Artificial Sequence
  mRNA product Design1 comprising derived and/or modified sequence from Mus musculus__NP_001273985.1__MmVEGFA (opt2)
gggagaaagcuuaccaugaacuuccuccucuccuggguccacuggacccucgcccuccuccucuaccuccaccacgccaaguggucccaggccgcccccaccaccgagggcgagcagaagucccacgaggucaucaaguucauggacgucuaccagcgcuccuacugccgccccaucgagacccucgucgacaucuuccaggaguaccccgacgagaucgaguacaucuucaagcccuccugcgucccccucaugcgcugcgccggcugcugcaacgacgaggcccucgagugcguccccaccuccgaguccaacaucaccaugcagaucaugcgcaucaagccccaccagucccagcacaucggcgagauguccuuccuccagcacucccgcugcgagugccgccccaagaaggaccgcaccaagcccgagaagaaguccguccgcggcaagggcaagggccagaagcgcaagcgcaagaagucccgcuucaaguccugguccguccacugcgagcccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5330 - RNA, 847 nt, Artificial Sequence
  mRNA product Design1 comprising derived and/or modified sequence from Homo sapiens__NP_061986.1__HsFGF21(L126R,P199G,A208E) (opt3)
gggagaaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugagagauuacuggaagauggguauaacgucuaccagagcgaggcacacggacuucccuugcaucugccugguaauaaaaguccacacagggaccccgccccucggggcccagcucgcuuucuaccgcuccccgggcugccuccagcccuucccgaaccuccaggcauucuggcgccccagccgccugaugugggauccucugaccccuugagcaugguuggugggucccagggaagaucaccaaguuaugagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5331 - RNA, 2404 nt, Artificial Sequence
  mRNA product Design1 comprising derived and/or modified sequence from Mus musculus__NP_001276387.1__MmHGF (opt3)
gggagaaagcuuaccaugauguggggcaccaagcugcuccccgugcuucuguugcagcacgucuuacugcaucuacuccugcuucacguugccaucccuuacgcugaggggcaaaagaagagaaggaacacacugcaugaguucaaaaagagcgcaaaaacuacguugaccaaggaggacccacuccugaagauuaaaacaaagaaaguaaauuccgccgaugaaugcgcgaaccgguguauacgcaaucgaggauuuacuuuuaccugcaaggcuuucguguucgacaaaucucguaagagauguuauugguacccguuuaacucaaugaguagcggugugaagaaaggcuucgggcacgaguuugaucuguaugaaaauaaggacuacaucaggaacugcauuaucggaaaaggcgguuccuauaaggggacagucucuauuaccaaaucgggaaucaagugucagcccuggaacucaaugauaccucaugagcacagcuuccucccaaguuccuaccggggcaaagauuuacaggagaauuauugccgcaaucccagaggcgaagaagggggaccuugguguuuuacuucuaacccagaagugagguacgagguuugcgacaucccccaguguagcgagguggaaugcaugacauguaauggugaguccuaccggggcccuauggaucacaccgaaucagggaagacgugccaacgcugggaccagcagacuccacaucgacacaaguuccugccggagagauaucccgauaaaggauuugacgauaacuacugcaggaauccugacggcaagccacggcccugguguuauacccuugauccugacacaccaugggaauacugcgccauuaaaacuugugcacauagugccgucaacgagaccgacgugcccauggagacaaccgaaugcauccagggucaaggggagggauaucguggcacgagcaauacuauuuggaacggcaucccgugucagcgcugggauucucaguacccucacaagcacgacauaacacccgaaaacuucaaaugcaaggauuugagagagaauuauuguaggaacccagacggggcugaauccccuuggugcuuuaccacugaucccaauauucggguaggauacuguucacagaucccaaagugcgacguuagcaguggucaagauuguuaccgaggcaacgggaaaaauuauaugggaaaccugucuaagacacgcuccggccuaaccugcagcaugugggacaaaaauauggaggaucuccauagacacauuuucugggagcccgacgcaucgaagcugaacaaaaauuacugcaggaacccugaugacgacgcccaugguccaugguguuauacggggaauccgcuuauccccugggauuacugcccuaucucucggugugaaggcgacaccacaccaacuauugugaaccuggaucaccccgucauauccugcgcuaagaccaagcaguugcgcguggugaauggaaucccuacacagacuaccgucggcuggaugguuucacucaaauauagaaacaagcauauuugugggggaagucugaucaaagagagcuggguguuaacagccaggcaaugcuucccagcgcguaauaaggaccugaaagauuacgaagcauggcucgguauacacgacguacacgagcggggcgaagagaagcgaaagcagauucuuaacaucucccagcugguguaugggcccgagggaucugauuugguccuacugaaacucgccagaccggcuauccuggacaacuuugugagcaccauugaucuuccuucauacggcuguacuaucccagaaaagacgacaugcaguauuuacgguuggggguauaccggccugauaaaugccgacggauugcucaggguugcacaucuguacaucaugggcaacgagaaauguucccagcaccaucaagggaaggugacuuuaaaugaaagcgagcugugcgcuggagccgagaaaauugguucuggccccugugaaggggauuauggaggcccucuaaucugcgagcagcacaagaugcgcaugguccucggugugaucguacccgggcggggcugcgcgauuccaaacagaccuggaauauucguuaggguggccuacuaugcaaaauggauccacaaggucauucugaccuacaaacuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5332 - RNA, 865 nt, Artificial Sequence
  mRNA product Design1 comprising derived and/or modified sequence from Homo sapiens__NP_002119.1__HsHMGB1 (opt3)
gggagaaagcuuaccaugggcaagggggaccccaaaaagccuagaggaaaaaugagcuccuacgccuucuuugugcagaccugcagggaggaacacaagaaaaagcauccagaugcuucugucaacuucucagaguuuaguaagaaauguagcgaacgguggaagacaauguccgcaaaagagaaggguaaauucgaagacauggccaaggcggauaaggcucgcuaugagcgagagaugaaaacuuacaucccgcccaagggcgaaacgaaaaagaaauuuaaggacccuaaugccccaaaacgucccccuucugcauucuuucuguucugcucggaguauagaccaaagauuaagggggaacaccccggacucucaauaggcgauguugccaagaaacuuggugagauguggaacaauaccgcugcagacgauaaacaaccuuacgagaagaaagccgcuaagcugaaggaaaaauaugagaaggacaucgccgcguacagggcaaaagggaagccagaugccgcuaaaaagggagugguaaaggccgagaaaagcaagaaaaagaaagaagaagaggaggacgaagaggaugaagaggacgaagaggaggaagaggaugaagaggacgaagacgaggaggaagaugacgaugacgagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5333 - RNA, 862 nt, Artificial Sequence
  mRNA product Design1 comprising derived and/or modified sequence from Mus musculus__NP_001273985.1__MmVEGFA (opt3)
gggagaaagcuuaccaugaacuuccugcucagcugggugcacuggacccuugcccuguuguuauaccugcaucacgcuaaguggucccaggcagcccccacaacugagggcgaacaaaaaucucaugaggucaucaaguuuauggacguuuaucagagaucauacugcaggccuauugaaacgcuaguggauauauuccaggaguauccagacgaaaucgaguacauuuuuaaaccgaguuguguaccccucaugcggugcgcgggguguugcaaugaugaggcucuggaaugugugccuaccagcgaguccaacaucacaaugcagauuaugcgcaucaagccacaccaaucucagcauauaggagaaaugucguuccuucagcacucacgaugcgagugucgucccaaaaaggacagaacuaagccugagaaaaagagcgucagggguaaaggcaaggggcagaaacggaagcgcaagaaaaguagauuuaaguccuggucugugcacugcgaaccauguagcgagaggcggaaacaucuguucguucaagauccccagaccugcaaguguuccugcaaaaauacagacucacgcugcaaggcccgacaguuggaacucaacgagagaaccuguaggugcgauaaaccucggcguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5334 - RNA, 847 nt, Artificial Sequence
  mRNA product Design1 comprising derived and/or modified sequence from Homo sapiens__NP_061986.1__HsFGF21(L126R,P199G,A208E) (opt4)
gggagaaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagagacugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggcggcagccagggcagaagccccagcuacgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5335 - RNA, 2404 nt, Artificial Sequence
  mRNA product Design1 comprising derived and/or modified sequence from Mus musculus__NP_001276387.1__MmHGF (opt4)
gggagaaagcuuaccaugauguggggcaccaagcugcugcccgugcugcugcugcagcacgugcugcugcaccugcugcugcugcacguggccauccccuacgccgagggccagaagaagagaagaaacacccugcacgaguucaagaagagcgccaagaccacccugaccaaggaggacccccugcugaagaucaagaccaagaaggugaacagcgccgacgagugcgccaacagaugcaucagaaacagaggcuucaccuucaccugcaaggccuucguguucgacaagagcagaaagagaugcuacugguaccccuucaacagcaugagcagcggcgugaagaagggcuucggccacgaguucgaccuguacgagaacaaggacuacaucagaaacugcaucaucggcaagggcggcagcuacaagggcaccgugagcaucaccaagagcggcaucaagugccagcccuggaacagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccccauggaccacaccgagagcggcaagaccugccagagaugggaccagcagaccccccacagacacaaguuccugcccgagagauaccccgacaagggcuucgacgacaacuacugcagaaaccccgacggcaagcccagacccuggugcuacacccuggaccccgacacccccugggaguacugcgccaucaagaccugcgcccacagcgccgugaacgagaccgacgugcccauggagaccaccgagugcauccagggccagggcgagggcuacagaggcaccagcaacaccaucuggaacggcauccccugccagagaugggacagccaguacccccacaagcacgacaucacccccgagaacuucaagugcaaggaccugagagagaacuacugcagaaaccccgacggcgccgagagccccuggugcuucaccaccgaccccaacaucagagugggcuacugcagccagauccccaagugcgacgugagcagcggccaggacugcuacagaggcaacggcaagaacuacaugggcaaccugagcaagaccagaagcggccugaccugcagcaugugggacaagaacauggaggaccugcacagacacaucuucugggagcccgacgccagcaagcugaacaagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccacccagaccaccgugggcuggauggugagccugaaguacagaaacaagcacaucugcggcggcagccugaucaaggagagcugggugcugaccgccagacagugcuuccccgccagaaacaaggaccugaaggacuacgaggccuggcugggcauccacgacgugcacgagagaggcgaggagaagagaaagcagauccugaacaucagccagcugguguacggccccgagggcagcgaccuggugcugcugaagcuggccagacccgccauccuggacaacuucgugagcaccaucgaccugcccagcuacggcugcaccauccccgagaagaccaccugcagcaucuacggcuggggcuacaccggccugaucaacgccgacggccugcugagaguggcccaccuguacaucaugggcaacgagaagugcagccagcaccaccagggcaaggugacccugaacgagagcgagcugugcgccggcgccgagaagaucggcagcggccccugcgagggcgacuacggcggcccccugaucugcgagcagcacaagaugagaauggugcugggcgugaucgugcccggcagaggcugcgccauccccaacagacccggcaucuucgugagaguggccuacuacgccaaguggauccacaaggugauccugaccuacaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5336 - RNA, 865 nt, Artificial Sequence
  mRNA product Design1 comprising derived and/or modified sequence from Homo sapiens__NP_002119.1__HsHMGB1 (opt4)
gggagaaagcuuaccaugggcaagggcgaccccaagaagcccagaggcaagaugagcagcuacgccuucuucgugcagaccugcagagaggagcacaagaagaagcaccccgacgccagcgugaacuucagcgaguucagcaagaagugcagcgagagauggaagaccaugagcgccaaggagaagggcaaguucgaggacauggccaaggccgacaaggccagauacgagagagagaugaagaccuacaucccccccaagggcgagaccaagaagaaguucaaggaccccaacgcccccaagagaccccccagcgccuucuuccuguucugcagcgaguacagacccaagaucaagggcgagcaccccggccugagcaucggcgacguggccaagaagcugggcgagauguggaacaacaccgccgccgacgacaagcagcccuacgagaagaaggccgccaagcugaaggagaaguacgagaaggacaucgccgccuacagagccaagggcaagcccgacgccgccaagaagggcguggugaaggccgagaagagcaagaagaagaaggaggaggaggaggacgaggaggacgaggaggacgaggaggaggaggaggacgaggaggacgaggacgaggaggaggacgacgacgacgagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5337 - RNA, 862 nt, Artificial Sequence
  mRNA product Design1 comprising derived and/or modified sequence from Mus musculus__NP_001273985.1__MmVEGFA (opt4)
gggagaaagcuuaccaugaacuuccugcugagcugggugcacuggacccuggcccugcugcuguaccugcaccacgccaaguggagccaggccgcccccaccaccgagggcgagcagaagagccacgaggugaucaaguucauggacguguaccagagaagcuacugcagacccaucgagacccugguggacaucuuccaggaguaccccgacgagaucgaguacaucuucaagcccagcugcgugccccugaugagaugcgccggcugcugcaacgacgaggcccuggagugcgugcccaccagcgagagcaacaucaccaugcagaucaugagaaucaagccccaccagagccagcacaucggcgagaugagcuuccugcagcacagcagaugcgagugcagacccaagaaggacagaaccaagcccgagaagaagagcgugagaggcaagggcaagggccagaagagaaagagaaagaagagcagauucaagagcuggagcgugcacugcgagcccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5338 - RNA, 847 nt, Artificial Sequence
  mRNA product Design1 comprising derived and/or modified sequence from Homo sapiens__NP_061986.1__HsFGF21(L126R,P199G,A208E) (opt5)
gggagaaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagagacugcuugaagauggcuauaacguguaccaguccgaggcccacgggcugccccuccaucugccuggaaauaaaagcccgcaccgggaccccgcgccucgcggccccgccagauuucugccucuccccgggcugccgccugcccuucccgaaccucccggaauccuggcuccccagccuccggauguugggucuuccgacccccucagcauggugggcgggucucagggacgguccccuagcuaugagucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5339 - RNA, 2404 nt, Artificial Sequence
  mRNA product Design1 comprising derived and/or modified sequence from Mus musculus__NP_001276387.1__MmHGF (opt5)
gggagaaagcuuaccaugauguggggcaccaagcugcuccccgugcugcuucugcagcacguccuccugcaucuucugcuccugcacguugccaucccuuacgcugaggggcagaaaaagagacggaacacacugcaugaguucaaaaagagcgccaaaacgacccucacaaaggaagacccgcugcuuaagauuaaaaccaagaaagucaauuccgcggaugaaugcgcuaaccgcuguaucagaaaucggggauuuacauuuaccugcaaggccuucguguucgacaaaucucgcaagagauguuauugguaccccuuuaacagcauguccucuggcgugaagaaaggguucggacacgaguuugaucuguaugaaaauaaggacuacauucggaacugcaucauuggcaaagggggaagcuauaagggcacaguguccaucaccaaaucuggcaucaagugucaaccuuggaauagcaugauuccccaugagcacuccuuccucccuagcucuuaccgcgggaaagaucugcaggagaacuauugcagaaauccccggggagaagagggcgggccuugguguuuuacguccaacccggaaguucgcuacgaggugugcgacaucccccaguguagcgaggucgaaugcaugaccuguaauggagagucuuacagaggcccuauggaucacacagaauccgggaagaccugccaacggugggaccagcagacaccccaucgccacaaguuccuuccugagagauaucccgauaaaggauuugacgauaacuacugccggaauccggacggcaagccucgccccugguguuauacccuggauccugacacgcccugggaauacugcgccauuaaaacaugugcucauagcgccgugaacgagaccgacguucccauggagacaaccgaaugcauccagggccaaggggagggauauagaggcaccucuaauacaauuuggaacgggaucccuugucagcggugggauucccaguacccgcacaagcacgacauuacgcccgaaaacuucaaaugcaaggaucucagagagaauuauugucgcaacccugacggagcugaaagccccuggugcuuuaccacagauccuaauauccgggugggcuacuguucccagauccccaagugcgacgucucuagcgggcaagauuguuacagaggaaacggcaaaaauuauaugggcaaccuguccaagacccgcagcgggcugacaugcucuaugugggacaaaaauauggaggaucuccaucggcacauuuucugggagccggacgccuccaagcugaacaaaaauuacugcagaaacccugaugacgacgcgcauggacccugguguuauaccggcaauccucuuauccccugggauuacugcccuauuagccgcugugaaggggacacgacacccaccaucgugaaccuggaucacccggugauuucuugcgccaagaccaagcagcuccgggucguuaauggaaucccuacacagaccacagugggcuggauggugagccugaaauauagaaacaagcauaucugugggggcucccuuauuaaagagucuuggguccugacggcucgccaaugcuuccccgcccggaauaaggaccucaaagauuacgaggcuuggcugggaauccacgacgugcacgaaagaggcgaagagaagcgcaagcagauucugaacaucagccagcucguuuaugggcccgagggauccgaucuggugcuucugaaacucgcccggccugcgauucuggacaacuuugucagcaccaucgaucuuccgucuuacggcuguacaauccccgaaaagaccacaugcuccauuuacggguggggauauaccggccugaucaaugccgacgggcuccugagaguggcucaucuguacauuaugggcaacgagaaauguagccagcaccaucaaggaaagguuacgcucaaugaaucugagcugugcgccggcgcugagaaaaucggguccggaccuugugaaggcgauuaugggggaccccuuauuugcgagcagcacaagaugcggauggugcugggcgucaucgugccugggcgcggcugcgccauucccaacagaccuggaaucuucguccggguggccuacuaugcuaaauggauccacaagguuauucucaccuacaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5340 - RNA, 865 nt, Artificial Sequence
  mRNA product Design1 comprising derived and/or modified sequence from Homo sapiens__NP_002119.1__HsHMGB1 (opt5)
gggagaaagcuuaccaugggcaagggggaccccaaaaagccuagaggaaaaaugagcuccuacgccuucuuugugcagaccugccgggaggaacacaagaaaaagcauccggaugcuucugucaacuucagcgaguuuuccaagaaauguucugaacgcuggaagacaaugagcgccaaagagaagggcaaauucgaagacauggcgaaggcugauaaggccagauaugagcgggagaugaaaacguacauucccccuaagggggaaaccaaaaagaaauuuaaggaccccaaugccccuaaaagacccccuuccgcuuucuuucuguucugcucugaguaucgcccgaagaucaagggagaacaccccggccucagcaucggggauguugccaaaaagcugggagagauguggaacaauacagcugccgacgauaaacaaccuuacgagaagaaagcggccaaacuuaaggaaaaguaugagaaggacauugcugccuaccgggcuaaaggcaagcccgaugccgcgaaaaagggcguggugaaggccgaaaaauccaagaaaaagaaagaggaagaggaggacgaagaggaugaagaggacgaagaggaggaagaggaugaagaggacgaagacgaggaggaagaugacgaugacgagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5341 - RNA, 862 nt, Artificial Sequence
  mRNA product Design1 comprising derived and/or modified sequence from Mus musculus__NP_001273985.1__MmVEGFA (opt5)
gggagaaagcuuaccaugaacuuccugcucagcugggugcacuggacccuggcccuucugcucuaccugcaucacgcuaaguggucccaggccgcgcccacaacggagggcgaacaaaaaucucaugaggucaucaaguuuauggacguuuaucagagaagcuacugccggccuauugaaacccuuguggauaucuuccaggaguauccggacgaaauugaguacaucuuuaaacccuccugugugccucugaugcgcugcgcuggguguugcaaugaugaggcccucgaauguguccccacaucugagagcaacauuaccaugcagaucaugagaaucaagccucaccaaucccagcauauuggagaaaugucuuuccugcagcacagccggugcgagugucgccccaaaaaggacagaacaaagccugagaaaaaguccgugcggggcaaagggaagggacagaaacgcaagagaaagaaaagccgguuuaagucuugguccguucacugcgaaccguguagcgagcgcagaaaacaucuguucgugcaagauccccagaccugcaaguguucuugcaaaaauacagacucccggugcaaggcccgccagcucgaacugaacgagagaaccugucggugcgauaaaccucgcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5342 - RNA, 847 nt, Artificial Sequence
  mRNA product Design1 comprising derived and/or modified sequence from Homo sapiens__NP_061986.1__HsFGF21(L126R,P199G,A208E) (opt6)
gggagaaagcuuaccauggauucagaugaaacaggauuugaacacucaggauuaugggucucaguuuuagcaggacuauuacuaggagcaugucaagcacauccaauaccagacucaagcccauuauuacaauuuggaggacaaguaagacaaagauauuuauauacagaugacgcacaacaaacagaagcacauuuagaaauaagagaagacggcacaguaggaggagcagcagaucaaucaccagaaucacuauuacaauuaaaagcauuaaaaccaggaguaauacaaauauuaggaguaaaaacaucaagauucuuaugccaaagaccugacggagcauuauaugguucacuacacuuugacccagaagcauguucauucagagaaagacuacuagaagacggauauaauguuuaccaaucugaagcacauggauuaccacuacacuuaccaggaaauaaaucaccacaccgagacccagcaccacgaggaccagcaagauuccuaccacuaccaggauuaccaccagcauuaccagaaccaccaggaauacuagcuccacaaccaccagacguaggauccucagauccauuaucaaugguaggaggaucucaagguagaagucccucauacgaaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5343 - RNA, 2404 nt, Artificial Sequence
  mRNA product Design1 comprising derived and/or modified sequence from Mus musculus__NP_001276387.1__MmHGF (opt6)
gggagaaagcuuaccaugauguggggaacaaaacuauuaccaguauuauuauuacaacaugucuuauuacauuuacuucuacuacauguugcaauacccuaugccgaaggacaaaagaaaagaagaaacacucuucacgaguucaagaaaagcgcaaaaacaacauuaacaaaagaagacccacuacuaaaaauaaaaacaaagaaaguaaacucagcagaugaaugugccaacagauguauuagaaaccgggguuuuacuuuuacaugcaaagccuucguauucgauaaaucaaggaaaagaugcuacugguauccauucaauucaaugucauccggagucaagaaaggauucggccaugaauuugaccuauacgaaaauaaagauuauaucagaaacuguauaauaggaaaaggugguucauacaaaggaacaguaucaauaacaaaaagcgguauuaaaugucaacccuggaacucuaugauuccucaugaacauucauuuuuaccaucaucauacagagguaaagacuuacaagaaaauuacugcagaaauccaaggggagaagaaggcggaccauggugcuuuacaucaaaucccgaaguaagauaugaaguaugcgacauaccacaauguagugaaguugaauguaugacauguaauggagaaagcuacagagguccaauggaucauacagaaucaggaaaaacaugccaaagaugggaucaacaaacaccgcauagacauaaauuuuuaccagaaagauauccagauaaaggauucgaugacaauuacuguaggaaucccgacggaaaaccacgaccauggugcuauacacuagacccugauacuccaugggaauauugcgcuauaaaaacuugugcacauucagcaguaaacgaaaccgacguaccaauggaaaccacugaauguauacaagggcaaggagaaggauacagaggaacaucaaauacaauauggaacggaauacccugucaaagaugggauagccaauauccacauaaacacgacauaaccccagaaaacuuuaaauguaaagaucuaagagaaaauuacugcagaaaucccgauggcgcagaaucaccauggugcuucacaacagaucccaacauaagagucggauauugcucccagauuccuaaaugugauguaagcuccgggcaagacugcuaccgaggcaacgguaaaaauuacaugggaaacuuaaguaaaacaagaucaggauuaacaugcaguaugugggauaaaaauauggaggacuuacauagacauauauucugggaaccagaugcaucaaaacuuaacaaaaauuauugcagaaacccagacgacgaugcacacggaccaugguguuauacaggaaauccacuuauaccaugggacuauuguccaauaucacgaugcgaaggagauacaacaccaacaauaguaaacuuagaucauccaguaauaaguugcgcaaaaacuaaacaauuacgaguuguuaacggaauaccaacacaaacuacagucggauggaugguuucauuaaaauauagaaacaaacacauaugcggaggaucccuuauaaaagaauccuggguauuaacagcaagacaauguuuuccagccagaaauaaagaucucaaagacuacgaagcaugguuaggcauacacgauguacaugaacgaggagaagaaaaacgaaaacaaauauuaaauauaagccagcuaguuuauggaccagaaggaucggacuuaguacuauuaaaacuugcaagaccagcaauccuagacaauuuugucucaacaaucgacuuacccucauauggaugcacuauuccggagaaaacaacaugcuccauauacggauggggauauacaggauugauaaaugcagauggauuacuaagaguagcacaucuauacauaaugggaaaugaaaaauguucacaacaccaucaaggaaaaguaacacuaaacgaaagcgaauuaugugcaggcgcagagaaaauaggcaguggaccaugugaaggagauuacgguggaccacuaauaugcgaacaacauaaaaugagaaugguccuaggaguaauaguccccggaagaggaugugcaauaccaaaucgaccgggcauauuuguaagaguagcauacuacgcaaaauggauacacaaaguaauacuaacauacaaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5344 - RNA, 865 nt, Artificial Sequence
  mRNA product Design1 comprising derived and/or modified sequence from Homo sapiens__NP_002119.1__HsHMGB1 (opt6)
gggagaaagcuuaccaugggaaaaggagacccaaaaaaaccaagaggaaaaaugucaagcuacgcauucuucguacaaacaugcagagaagaacacaaaaaaaaacacccagacgcaagcguaaacuucagcgaauucagcaaaaaauguucagaaagauggaaaacaaugagcgcaaaagaaaaaggaaaauucgaagacauggcaaaagcagacaaagcaagauacgaaagagaaaugaaaacauacauaccaccaaaaggagaaacaaaaaaaaaauucaaagacccaaacgcgccaaaaagaccaccaucagcauucuucuuauucugcagugaauacagaccaaaaauaaaaggagaacacccaggacuaaguauaggagacguagcaaaaaaacuaggagaaauguggaacaacacagcagcagacgacaaacaaccauacgaaaaaaaagcagcaaaacuaaaagaaaaauacgaaaaagacauagcggcauacagagcaaaaggaaaaccagacgcagcaaaaaaaggaguaguaaaagcagaaaaaaguaaaaaaaaaaaagaagaagaagaagacgaagaagacgaagaagacgaagaagaagaagaagacgaagaagacgaagacgaagaagaagacgacgacgacgaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5345 - RNA, 862 nt, Artificial Sequence
  mRNA product Design1 comprising derived and/or modified sequence from Mus musculus__NP_001273985.1__MmVEGFA (opt6)
gggagaaagcuuaccaugaacuuccuauuaagcuggguacacuggacacuagcacuacuacuauacuuacaccacgccaaauggagccaagcagcaccaacaacagaaggagaacaaaaaucacacgaaguaauaaaauucauggacguauaccaaagaucauacuguagaccaauagaaacacuaguagacauauuccaagaauacccagacgaaauagaauacauauucaaaccaucaugcguaccacuaaugagaugcgcaggaugcugcaacgacgaagcacuagaaugcguaccaacaucagaaucaaacauaacaaugcaaauaaugagaauaaaaccacaccaaagucaacacauaggagaaaugaguuuccuacaacacucaagaugcgaaugcagaccaaaaaaagacagaacaaaaccagaaaaaaaaucaguaagaggaaaaggaaaaggccaaaaaagaaaaagaaaaaaaucaagauucaaaagcuggucaguacacugugaaccauguucagaaagaagaaaacaccuauucguacaagacccacaaacaugcaaaugcaguugcaaaaacacagacucaagaugcaaagcaagacaacuagaauuaaaugaacgaacaugcagaugcgacaaaccaagaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5346 - RNA, 847 nt, Artificial Sequence
  mRNA product Design1 comprising derived and/or modified sequence from Homo sapiens__NP_061986.1__HsFGF21(L126R,P199G,A208E) (opt7)
gggagaaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagaggcugcuggaagauggguauaacguguaccagagugaggcccacggcuugccccuccaucugccagguaauaaaagcccgcaccgggaccccgcaccacgcgggcccgccagguuucugccacuccccggccugccgcccgccuugccagaacccccaggcauccuggcaccccagccaccggaugugggguccagcgacccccucaguauggucgguggcucccaggggcggagcccauccuaugagaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5347 - RNA, 2404 nt, Artificial Sequence
  mRNA product Design1 comprising derived and/or modified sequence from Mus musculus__NP_001276387.1__MmHGF (opt7)
gggagaaagcuuaccaugauguggggcaccaagcugcuccccgugcuguugcugcagcacguccuccugcauuugcugcuccugcacguggccaucccauacgcagaggggcagaaaaagaggcggaacacucugcaugaguucaaaaagagcgccaaaaccacgcucacuaaggaggacccgcuguugaagauuaaaaccaagaaaguaaauuccgcggaugaaugcgccaaccgcuguaucaggaaucgggguuuuaccuucacuugcaaggcauuuguguucgacaaaagucgcaagagguguuauugguaccccuuuaacagcauguccaguggcgucaaaaagggguucggccacgaguuugaucuguaugaaaauaaggacuacauucggaacugcaucauugguaaagggggcagcuauaagggcaccguguccaucacgaaaagcgggaucaagugucaaccauggaacuccaugauuccccaugagcacaguuuccucccaagcuccuaccgcgguaaagaucugcaggagaauuauugcaggaauccccggggcgaagaagggggcccaugguguuuuacuagcaacccggaagugcgcuacgaggucugcgacaucccccaguguagugagguggaaugcaugaccugcaauggugaguccuacagggggccaauggaucacacugaaagcggcaagaccugucaacggugggaccagcagacuccccaucgccacaaguuccugccagagagguaucccgauaaaggcuuugacgauaacuacugccggaauccggacgggaagccccgcccaugguguuauacguuggaucccgacacuccaugggaauacugcgccauuaaaaccugugcacauuccgccguaaacgagacugacgugcccauggagaccaccgaaugcauccagggucaaggcgagggguauaggggcaccaguaauacgauuuggaacgguaucccaugucagcggugggauagccaguacccgcacaagcacgacauuacccccgaaaacuucaaaugcaaggaucuccgcgagaauuauuguaggaacccagacggcgcggaaucccccuggugcuucacuaccgauccaaauauccgggucggguacugcagccagauccccaagugugacgugaguuccggccaagauugcuacagggggaacgguaaaaauuauaugggcaaccugagcaagacccgcagugggcugacuuguuccaugugggacaaaaauauggaggaucuccaucggcacaucuuuugggagccggacgccagcaagcugaacaaaaauuacugcaggaacccagaugacgacgcacauggccccugguguuauacggguaaucccuugauuccaugggauuacugccccauuagccgcugugaaggcgacaccacuccaaccaucgugaaccuggaucacccggucauuuccugcgccaagaccaagcagcuccgggugguaaaugggauccccacucagacgaccgugggcuggauggucagucugaaauauaggaacaagcauaucugugggggcagccugauuaaagaguccuggguguugacugcccgccaaugcuucccagcacggaauaaggaccucaaagauuacgaagccuggcuggguauccacgacgugcacgagaggggcgaagagaagcggaaacagauucugaacaucagccagcucgucuaugggcccgaggguagugaucugguguugcugaagcucgcgcgcccagccauucuggacaacuuuguauccaccaucgaucugcccagcuacggcuguacuaucccggaaaagaccacgugcuccauuuacggguggggcuauaccggguugaucaaugcagacggccuccugaggguggcccaucuguacauuauggguaacgagaaaugcagucagcaccaucaagggaaggucacucucaaugaaagcgagcugugugcaggcgccgagaaaaucggcuccgggccaugcgaaggugauuauggcgggcccuugauuugugagcagcacaagaugcggauggugcugggcgucaucgugccaggucgcgggugcgccauucccaacaggccgggcaucuucgugcggguagcguacuaugcaaaauggauccacaaggugauucucaccuacaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5348 - RNA, 865 nt, Artificial Sequence
  mRNA product Design1 comprising derived and/or modified sequence from Homo sapiens__NP_002119.1__HsHMGB1 (opt7)
gggagaaagcuuaccaugggcaagggggaccccaaaaagccaagggguaaaaugagcuccuacgccuucuuugugcagaccugccgggaggaacacaagaaaaagcauccggaugcaagugucaacuucagcgaguuuuccaagaaauguagugaacgcuggaagacuaugagcgccaaagagaagggcaaauucgaagacauggcgaaggccgauaaagcaagguaugagcgggagaugaagaccuacauucccccaaagggggaaacgaaaaagaaauuuaaggaccccaaugccccaaaaaggcccccauccgcauucuuucuguucugcagcgaguaucgcccgaagaucaagggcgaacaccccggucucuccaucggggauguggccaaaaagcugggcgagauguggaacaauacugcggccgacgauaaacaaccauacgagaagaaagcagccaaguugaaggaaaaauaugagaaggacauugccgcauaccgggccaaaggcaagcccgaugcggccaaaaaggggguagugaaggcagagaaaaguaagaaaaagaaagaagaagaggaggacgaagaggaugaagaggacgaagaggaggaagaggaugaagaggacgaagacgaggaggaagaugacgaugacgagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5349 - RNA, 862 nt, Artificial Sequence
  mRNA product Design1 comprising derived and/or modified sequence from Mus musculus__NP_001273985.1__MmVEGFA (opt7)
gggagaaagcuuaccaugaacuuccugcucagcugggugcacuggacccuggccuugcugcucuaccugcaucacgcaaaguggucccaggccgcgcccacuaccgagggcgaacagaaaagucaugaggucaucaaguuuauggacguguaucaaaggagcuacugccggccaauugaaacguugguagauaucuuccaggaguauccggacgaaauugaguacaucuuuaaacccuccugugugccacugaugcgcugcgccggguguugcaaugaugaggcacucgaauguguccccaccagugagagcaacauuacuaugcagaucaugaggaucaagccacaccaaucccagcauauuggugaaaugagcuuccugcagcacucccggugcgagugucgccccaaaaaggacaggaccaagccagagaaaaagagugugcggggcaaagggaagggccagaaacgcaagaggaaaaagagccgguuuaaguccuggagcgugcacugcgaaccguguagugagcgcaggaaacaucuguucguccaagauccccagacuugcaagugcuccuguaaaaauaccgacagccggugcaaggcccgccagcucgaacugaacgagaggacgugucggugcgauaaaccaaggcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5350 - RNA, 847 nt, Artificial Sequence
  mRNA product Design1 comprising derived and/or modified sequence from Homo sapiens__NP_061986.1__HsFGF21(L126R,P199G,A208E) (opt8)
gggagaaagcuuaccauggacucugacgaaaccggcuucgaacacuccggacucugggucuccguccucgccggccuccuccuaggcgccugccaagcccaccccauccccgacucauccccacuccuacaauucggcggccaaguccgucaacgcuaccucuauaccgaugacgcccaacaaaccgaagcccaccucgaaauccgcgaagacggaaccgucggcggcgccgcugaccaaucacccgaaucccuccuccaacucaaagcacucaaacccggcguaauccaaauccucggcguaaaaaccucacgauuucuaugucaaagacccgacggagcccuauacggcucucuacacuucgacccagaagcaugcuccuuccgcgaacgacuccucgaagacggauacaacgucuaccaaucagaagcccacggccuaccccuccaccuccccggcaacaaaucuccccaccgcgaccccgcaccccgcggccccgcccgcuuccucccccuccccggccuacccccagcccuacccgaaccacccggcauacucgcaccccaaccacccgacgucggcuccuccgacccccuauccauggucggcggcucccaaggccgcucccccucauacgaaucuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5351 - RNA, 2210 nt, Artificial Sequence
  mRNA product Design1 comprising derived and/or modified sequence from Mus musculus__NP_001276387.1__MmHGF (opt8)
gggagaaagcuuaccaugauguggggcacgaaacugcucccaguauugcucuugcaacacguccuacuccaccuucuacugcuacacgucgcuauacccuaugccgaaggacaaaagaaacgucgcaacacccuacacgaauuuaagaaaagcgccaagaccacacucacuaaagaagauccccuacucaaaauaaagaccaaaaaggugaacucggcugacgaaugcgccaaccgaugcauccgaaacagaggcuucacuuuuaccugcaaagccuucguuuucgacaagagccgaaaacgaugcuacugguacccauucaacagcauguccuccgggguaaagaaaggcuucggacaugaguucgaucuauacgaaaauaaagacuacauaagaaacugcauaaucggcaaaggaggguccuacaaaggcacagucagcaucacaaagucagggaucaaaugccaacccuggaacuccaugauaccacacgagcacaguuuccucccuaguagcuaccgaggaaaagaccuccaggagaacuacugccgcaacccccgcggggaagaaggcggaccuuggugcuucacaagcaaccccgagguccgcuacgaggucugcgacaucccccaaugcagcgaagucgagugcaugaccuguaacggagaaucauaccgaggcccaauggaucacaccgaauccggaaaaacaugccaacgaugggaccaacaaacaccgcaccgacacaaguuccuccccgaacgguaccccgacaaaggauucgacgacaacuacugccgcaaccccgacggaaaaccacgaccauggugcuacacgcucgacccggacacccccugggaauacugcgccaucaaaaccugcgcacacucagcggugaacgaaaccgauguaccaauggaaacaaccgaaugcauccaaggacaaggagagggcuacaggggcacgucaaauaccaucuggaacggcauaccaugccagcgcugggacagucaguacccccacaaacacgacauaacccccgaaaacuucaaaugcaaagaccucagagaaaacuacugccgcaaccccgacggcgccgaaucccccugguguuucacaaccgacccaaacauccgcgugggcuacugcucacaaauccccaagugcgacguaucaagcggccaagacugcuaucgcgggaacggcaaaaacuacaugggaaaccucucaaagaccagaagcggccuaacaugcucaaugugggacaaaaacauggaggaccuccaccggcacaucuuuugggaacccgacgcuuccaaacucaacaaaaacuacugccgaaaccccgacgacgaugcacacggcccauggugcuacacaggcaacccccugauacccugggacuacugccccaucuccagaugcgagggcgacacaacaccgaccaucguaaaucucgaccaccccguaaucuccugcgccaaaacaaaacaacuaagggucgugaacggaauccccacccaaacaacagugggcuggauggucagccucaaauacagaaacaagcacaucugcggcggcucccucaucaaggaaagcuggguacuaacagccaggcaaugcuuccccgccagaaauaaagaucuaaaagacuacgaagccuggcuaggcauccaugacguccacgaacgcggcgaggagaaacgaaaacaaauucucaacaucucucaacucgucuauggaccagaagggagcgaccucguucuucugaaacucgcccggcccgcaaucuuagacaacuucgucagcacaaucgaccuccccucauacggaugcaccaucccagaaaagacaaccugcagcauauacggauggggcuacaccggccugaucaacgcagacggccuucucagagucgcccaucucuacaucaugggaaacgaaaaaugcagccaacaccaccaaggcaaaguaacgcucaacgaauccgaacucugcgccggagcagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5352 - RNA, 865 nt, Artificial Sequence
  mRNA product Design1 comprising derived and/or modified sequence from Homo sapiens__NP_002119.1__HsHMGB1 (opt8)
gggagaaagcuuaccauggggaaaggggacccgaaaaagccaagaggaaagaugucgagcuaugccuuuuucgugcaaacgugcagggaagaacacaagaaaaagcacccggacgcgagcgugaacuuuagcgaguucucgaaaaagugcucagaaagguggaagaccaugagcgcgaaagaaaaagggaaauuugaagauauggcaaaagcggacaaggcaagguacgagcgagaaaugaagacauauaucccgccaaagggcgagacaaagaagaaauucaaagacccgaacgcgcccaagcgcccgccaucggccuuuuuccuauucugcagcgaguacaggcccaagauaaagggcgagcacccaggauugagcauaggcgaugucgcgaaaaagcuaggggaaauguggaacaacacggccgcggacgauaaacagccguaugaaaagaaagcggccaagcucaaggaaaaguacgagaaagauaucgcggccuauagagcgaaaggaaaaccggacgcggccaagaaagggguagugaaagcggaaaagagcaagaaaaagaaagaggaagaggaagaugaagaggacgaggaagacgaagaggaagaggaagaugaagaggacgaggacgaggaagaggacgaugacgaugaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5353 - RNA, 862 nt, Artificial Sequence
  mRNA product Design1 comprising derived and/or modified sequence from Mus musculus__NP_001273985.1__MmVEGFA (opt8)
gggagaaagcuuaccaugaacuuccuccucuccuggguccacuggacccucgcccuccuccucuaccuucaccacgcaaaauggucccaagccgcccccaccaccgaaggagaacaaaaaucccacgaagucauaaaauucauggacguauaccaacgaucauacugccgacccaucgaaacccuagucgacaucuuccaagaauacccagacgaaaucgaauacauauucaaacccuccugcguaccccucaugcgcugcgccggcugcugcaacgacgaagcccuagaaugcgucccaacaucagaaucaaacaucaccaugcaaaucaugcgcaucaaaccacaccaaucccaacacauaggcgaaauguccuuccuccaacacucacgcugcgaaugccgccccaaaaaagaccgaaccaaacccgaaaaaaaaucaguccgaggcaaaggaaaaggccaaaaacgcaagcgcaaaaaaucccgcuucaaauccugguccguccacugcgaacccugcuccgaacgccgaaaacaccucuucguccaagacccacaaaccugcaaaugcuccugcaaaaacaccgacuccagaugcaaagcacgccaacucgaacucaacgaaagaaccugccgcugcgacaaaccccgccgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5354 - RNA, 847 nt, Artificial Sequence
  mRNA product Design1 comprising derived and/or modified sequence from Homo sapiens__NP_061986.1__HsFGF21(L126R,P199G,A208E) (opt9)
gggagaaagcuuaccauggacuccgacgaaaccggauucgaacacucaggccucugggucucaguccucgccggccuccuccucggagccugccaagcccacccaauccccgacuccucaccacuccuccaauucggcggccaaguccgacaacgauaccucuacaccgacgacgcccaacaaaccgaagcccaccucgaaauccgcgaagacggcacaguaggaggcgccgccgaccaaucacccgaaucccuacuccaacuaaaagcacucaaacccggcgucauccaaauacucggcgucaaaaccucaagauuccucugccaacgccccgacggcgcccucuacggcucccuccacuucgaccccgaagccugcuccuuccgcgaacgccuccucgaagacggcuacaacgucuaccaauccgaagcccacggccucccccuccaccucccaggcaacaaauccccacaccgcgaccccgcaccccgcggcccagcccgcuuccucccccuccccggacuacccccugcccuacccgaaccaccaggcauccucgcaccccaaccacccgacgucggcuccuccgacccccucucaaugguaggcggcucacaaggccgaucccccuccuacgaauccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5355 - RNA, 2404 nt, Artificial Sequence
  mRNA product Design1 comprising derived and/or modified sequence from Mus musculus__NP_001276387.1__MmHGF (opt9)
gggagaaagcuuaccaugauguggggcacaaaacuccuuccgguacugcugcuacaacacgugcuucuccaccuccuucuacuccacgucgcaauccccuaugcagaagggcagaaaaagcgacgcaacacacuccacgaguucaagaaaucggccaaaacaacccuaaccaaagaggacccccuccucaaaaucaaaaccaagaaaguaaacuccgccgacgagugcgccaacagaugcauccgcaaccggggcuucaccuucacaugcaaagccuucguguucgauaaaagccgcaaacgaugcuacugguacccauucaacuccaugagcucgggaguuaagaaaggcuuuggccacgaauuugaccuauacgagaauaaagacuacauaagaaacugcaucaucgguaaaggcggcucauacaaagggaccguauccaucacaaaaagcggaauaaaaugccaaccguggaacucuaugauaccccacgaacacucauuccuaccauccucauaccgcggcaaagaccuacaagagaacuacugccgaaacccccgaggagaagaagggggaccauggugcuucaccucaaacccagagguacgguacgaagucugcgacaucccacaaugcagcgaaguagagugcaugaccuguaacggagaguccuaccggggaccaauggaccauaccgaaucgggaaaaacuugccaacgaugggaucaacaaacaccccaucgucacaaauuccuaccggaacgauacccagacaaaggauucgacgacaacuacugcagaaaucccgacgguaaacccagaccuuggugcuacacccuagaccccgacaccccaugggaauacugcgccauaaagaccugcgcacacucugccgucaacgagaccgacguccccauggaaacaaccgaaugcauacaggggcagggagagggcuaccgcggcaccagcaacaccaucuggaacgguauacccugccagcgaugggacagccaauacccccacaagcacgacauaaccccugagaacuucaagugcaaagaccuacgcgaaaacuacugccgaaacccagacggcgccgaaucaccaugguguuucacaacagacccaaacauccgcgucggcuacugcucccaaauacccaaaugcgacgucaguuccggacaagacugcuaccgaggcaacggaaagaacuacaugggaaaccucuccaaaacccguagcgguuuaacaugcuccaugugggacaagaacauggaagaccuacacagacauauauucugggaacccgacgcaagcaaacucaacaaaaauuacugccgcaaccccgacgacgaugcccauggccccuggugcuacaccggcaacccccugauccccugggacuacuguccaauaagccgaugcgagggggacaccaccccuaccaucgucaaccuggaccaccccgucaucuccugcgcaaaaaccaaacagcuccgaguagugaacggcaucccaacccagacaacggucggauggauggucucacuaaaauaccgaaacaaacacauaugcgguggaucccucaucaaagaaagcugggucuuaaccgcccgccaaugcuuccccgcacgaaacaaagaccuaaaagacuacgaagcauggcuaggcauccacgacguacacgaacgaggcgaagaaaaacgaaagcaaauccucaacaucucacaguuagucuacggaccagaagguucagaccucgugcuccuaaaguuagcccgccccgccauacuagacaacuucgucagcaccaucgaccuaccaucauacggaugcaccauaccagagaaaaccacaugcaguaucuacggcuggggcuacacgggccucaucaacgccgacggccuccuacgcguagcccaccucuauaucaugggcaacgaaaaaugcucacaacaccaccaagggaaaguaacacugaacgaauccgagcucugcgccggcgccgagaaaaucggauccggccccugcgaaggagacuacgggggaccacuaauaugcgaacagcacaagaugcgaaugguccucggagucaucguacccggccgaggcugcgcaauacccaaucgccccggcauauucguucgcguagccuacuacgcuaaauggauccacaaagucauacucaccuacaaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5356 - RNA, 865 nt, Artificial Sequence
  mRNA product Design1 comprising derived and/or modified sequence from Homo sapiens__NP_002119.1__HsHMGB1 (opt9)
gggagaaagcuuaccauggggaaaggggacccgaagaaaccaaggggaaaaaugucgagcuaugccuucuucgugcaaacgugcagggaggaacacaagaaaaagcacccagacgcgagcgugaacuuuagcgaguucucgaaaaagugcucggaaagguggaagacaaugagcgcgaaagagaaagggaaauuugaagauauggcgaaagcggacaaggccagguacgagcgagagaugaagaccuauaucccgcccaagggcgagacaaagaagaaauucaaagacccgaacgcgccaaagcgcccgcccucggcauuuuucuuguucuguagcgaguacaggccaaagaucaagggcgagcacccaggcuugagcauaggcgaugucgccaaaaagcucggggaaauguggaauaacacagcagcagacgauaaacagcccuaugaaaagaaagcggcaaagcucaaggaaaaguacgagaaagauaucgcggccuaucgcgcgaaagggaaaccggacgcggcaaagaaaggggucgugaaagcggaaaagagcaagaaaaagaaagaggaagaggaagaugaagaggacgaggaagaugaagaggaagaggaagaugaagaggacgaggacgaagaagaggacgaugacgaugaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5357 - RNA, 862 nt, Artificial Sequence
  mRNA product Design1 comprising derived and/or modified sequence from Mus musculus__NP_001273985.1__MmVEGFA (opt9)
gggagaaagcuuaccaugaacuuccuccucuccuggguccacuggacacucgcccuccuccuauaccuacaccacgccaaauggagccaagccgcccccacaaccgaaggcgaacaaaaaucccacgaagucaucaaauucauggacgucuaccaacgcuccuacugccgccccaucgaaacccucgucgacaucuuccaagaauaccccgacgaaaucgaauacaucuucaaacccuccugcgucccccucaugcgcugcgccggcugcugcaacgacgaagcccucgaaugcguccccaccucagaaucaaacauaacaaugcaaaucaugcgcaucaaaccccaccaaucccaacacaucggagaaauguccuuccuccaacacucacgcugcgaaugccgcccaaaaaaagaccgcaccaaacccgaaaaaaaauccguacgcggcaaaggcaaaggccaaaaacgcaaacgcaaaaaaucccgcuucaaaucauggucaguccacugcgaacccugcagcgaacgacgcaaacaccucuucguccaagacccacaaacaugcaaaugcuccugcaaaaacacagacucgcgcugcaaagcccgccaacucgaacuaaacgaacgcaccugccgcugcgacaaaccccgacgcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5358 - RNA, 847 nt, Artificial Sequence
  mRNA product Design1 comprising derived and/or modified sequence from Homo sapiens__NP_061986.1__HsFGF21(L126R,P199G,A208E) (opt11)
gggagaaagcuuaccauggacuccgacgaaaccggcuucgaacacuccggccucugggucuccguccucgccggccuccuccuaggcgcaugccaagcccaccccauacccgacuccucaccccuccuccaauucggcggccaaguccgccaacgcuaccuauacaccgacgacgcccaacaaacagaagcccaccucgaaauccgagaagacggcacagucggcggcgccgccgaccaaagccccgaaucccuccuccaacucaaagcccucaaacccggcgucauccaaauccucggcgucaaaacaucccgcuuccuaugccaacgccccgacggcgcccucuacggcucacuccacuucgaccccgaagccugcuccuuccgcgaacgccuccucgaagacggcuacaacgucuaccaauccgaagcccacggccuaccccuacaccuccccggcaacaaauccccucaccgcgaccccgcaccccgcggccccgcccgcuuccuaccccuccccggccucccccccgcccuacccgaaccccccggcauccucgccccccaacccccagacgucggcuccucugacccccucuccauggucggcggcucccaaggccgcucacccuccuacgaauccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5359 - RNA, 2404 nt, Artificial Sequence
  mRNA product Design1 comprising derived and/or modified sequence from Mus musculus__NP_001276387.1__MmHGF (opt11)
gggagaaagcuuaccaugauguggggaacaaaauuacuaccaguccuacuacuccaacacguccuacuccaccuacuacuacuccacgucgcaauccccuacgccgaaggacagaaaaagcgaagaaacacacuacacgaauuuaagaaaucagccaaaaccacccuaaccaaagaagacccccuacugaaaaucaaaacuaagaaagucaacuccgcagaugagugcgcaaaccgaugcauacgcaaccgcggcuucacauucacuugcaaagccuucguuuucgacaaaucacgaaaacgcugcuacugguaccccuuuaacucgaugagcucaggcgugaagaaaggcuucggccaugaguucgaccuauacgaaaauaaagauuacauacguaacugcaucaucggaaaagguggcagcuacaaaggcacugucucaauaacgaaaaguggcaucaaaugccaacccuggaacuccaugaucccucacgaacacucauuccuccccuccagcuacagagggaaagaccuacaagaaaacuacugccguaauccaagaggagaagaaggcggaccuuggugcuucaccuccaaccccgaaguaagauacgaagugugcgacauaccacaaugcuccgaagucgaaugcaugaccugcaacggcgaauccuaccgaggacccauggaccacaccgaaucagguaagaccugccaacgcugggaccaacaaacaccccacagacacaaauuccucccugaacgcuaccccgacaaaggcuucgacgacaacuacugcaggaacccagacgguaaaccccgacccugguguuacacccucgacccagauacacccugggaauacugcgccauaaaaacaugcgcacacuccgccgucaacgagacagacguccccauggaaaccaccgagugcauacaaggacaaggggaaggauacagaggaacaucaaacaccauuuggaacggcauacccugccaaagaugggacucccaguauccccacaaacacgacaucacaccagaaaacuucaaaugcaaggaccuacgagaaaacuacugccgcaacccagacggagcugaaucccccuggugcuucacaacagacccgaauauccgcgucggauacuguucgcaaaucccaaagugcgacgucagcucaggacaagacugcuacagaggaaacggcaagaacuauaugggcaaccuuucgaaaacacgcagcggccuaaccugcuccaugugggacaagaacauggaagaccuccaccggcacauauucugggaacccgacgcaaguaaacuuaacaaaaacuacugucgcaauccggacgacgacgcccacggcccuuggugcuacaccgguaacccccuaaucccgugggacuacugccccauaucccgaugcgaaggagauacaacacccaccaucgugaaccuagaccaccccgucaucucaugcgcuaaaacgaaacagcuccgagucgucaacggcaucccaacgcaaacgaccgucggauggauggucucccugaaauaccgcaacaaacacauaugcggcggaagccuaauaaaagaaagcuggguccuuacagcccggcaaugcuucccagcccguaacaaagaccucaaagacuacgaagccuggcucggcauccacgacguacaugaacgaggggaagaaaaacgcaaacaaauacucaacaucucccagcugguauacggcccggaaggaagcgaccucguccucuugaaacuagccagacccgccauacuagacaacuucgucagcaccaucgaccuccccucauacggcugcaccaucccagaaaagacaaccugcucaaucuacggcuggggcuacaccggacuaaucaacgccgacggacuccugcgggucgcccauuuguacaucaugggaaacgaaaaaugcucccaacaccaccaaggcaaagucacccugaacgaauccgaacucugcgcaggcgccgagaaaaucggaucaggacccugcgaaggggacuacgggggcccccucaucugcgagcaacauaaaaugcguauggugcuaggcgugaucguccccggacgcggaugcgccaucccgaaccgccccgggaucuucguccgcgucgccuacuacgccaaauggauacauaaagucauucucaccuacaagcuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5360 - RNA, 865 nt, Artificial Sequence
  mRNA product Design1 comprising derived and/or modified sequence from Homo sapiens__NP_002119.1__HsHMGB1 (opt11)
gggagaaagcuuaccauggggaaaggggacccgaaaaagccgaggggaaagaugucgagcuaugccuucuucgugcaaacgugcagggaggaacacaagaaaaagcacccggacgcgagcgugaacuucagcgaguucucgaaaaagugcucggaaagguggaagaccaugagcgcgaaagagaaagggaaauuugaagauauggcgaaagcggacaaggcaagguacgagcgagagaugaagacauauauaccaccaaagggcgagaccaagaaaaaguucaaggacccgaacgcgcccaagcgcccgccaucggccuuuuucuuguucuguagcgaguacaggcccaagaucaagggagagcacccgggcuugagcauaggcgacgucgcgaaaaagcucggggaaauguggaauaacacggccgcggacgauaaacagccauaugaaaagaaagcggccaagcuaaaggaaaaguacgagaaagauaucgcggcauaucgcgcgaaagggaaaccggacgcggccaagaaaggagucguaaaagcggaaaagagcaagaaaaagaaagaggaagaggaagaugaagaggacgaggaagaugaagaggaagaggaagaugaagaggacgaggacgaggaagaggacgaugacgaugaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5361 - RNA, 862 nt, Artificial Sequence
  mRNA product Design1 comprising derived and/or modified sequence from Mus musculus__NP_001273985.1__MmVEGFA (opt11)
gggagaaagcuuaccaugaacuuccuccuauccuggguccacuggacacucgcccuccuccucuaccuccaccacgccaaauggucccaagcagcacccaccacagaaggcgaacaaaaaucccacgaagucaucaaguucauggacgucuaccaacgcucauacugccgccccaucgaaacacucguagacaucuuccaagaauaccccgacgaaaucgaauacaucuucaaacccuccugcgucccacuaaugcgcugcgccggaugcugcaacgacgaagcccucgaaugcgucccaaccuccgaauccaacaucaccaugcaaaucaugcgcaucaaaccccaccaaucccaacacaucggcgaaauguccuuccuccaacacucccgcugcgaaugccgccccaaaaaagaccgcaccaaacccgaaaaaaaaucaguccgcggcaaaggcaaaggucaaaaacgaaaacgcaaaaaaucacgcuucaaauccugguccguccacugcgaacccugcucagaacgacgcaaacaccucuucguccaagacccccaaaccugcaaaugcucaugcaaaaacaccgacucccgaugcaaagcccgccaacucgaacucaacgaacgaaccugccgcugcgacaaaccccgacgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5362 - RNA, 847 nt, Artificial Sequence
  mRNA product Design1 comprising derived and/or modified sequence from Homo sapiens__NP_061986.1__HsFGF21(L126R,P199G,A208E) (opt12)
gggagaaagcuuaccauggacucugacgaaacagguuucgaacacucaggacuaugggucucaguauuagcaggacuauuauuaggagcaugucaagcacauccaauaccagacucaucaccacuacuacaauucggcggacaaguaagacaaagauacuuauacacagacgaugcacaacaaacagaagcacauuuagaaauaagagaagauggcacaguaggcggagcagcagaccaaucaccagaaucacuauuacaauuaaaagcauuaaaaccaggaguaauacaaauauuaggaguaaaaacaucaagauucuuaugucaaagaccugacggagcacuauacggaucacuacacuuugacccagaagcaugcucauuuagagaaagauuauuagaagacggauacaauguauaucaaucagaagcacacggauuaccauuacacuuacccggaaauaaaucaccacauagagacccagcaccaagaggaccugcaagauuucuaccucuaccaggacuaccaccagcacuaccugaaccaccaggaauauuagcaccacaaccaccagacguaggauccucagaccccuuaucaaugguaggcggaucacaaggaagaucaccaucauaugaaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5363 - RNA, 2404 nt, Artificial Sequence
  mRNA product Design1 comprising derived and/or modified sequence from Mus musculus__NP_001276387.1__MmHGF (opt12)
gggagaaagcuuaccaugauguggggaacuaaauuacuaccaguucuauuacuucaacacguccuauuacauuuauuacuauuacacguugcaauaccauaugcagaaggacaaaaaaaaagaaggaacaccuuacacgaauuuaaaaaaucggcaaaaacaacccucacaaaggaagacccacuauuaaaaaucaaaacaaaaaaagugaauagugcagacgaaugugcaaauagaugcauaagaaacagaggauuuacauucacuuguaaagcauuuguauuugauaaaucaaggaaaagguguuauugguauccuuuuaacucaaugucuaguggaguaaaaaaaggauucggacaugaauuugaccuauaugaaaauaaagacuauauaagaaauugcauaauaggaaaagguggaucauauaaagggacaguuagcauaaccaaaucaggcauaaaaugucaaccauggaauucaaugauaccacaugaacauuccuuucuaccuaguaguuaucguggaaaagauuuacaagaaaauuauuguagaaacccaagaggagaagaaggagggccauggugcuuuacaagcaacccagaagucagauaugaaguaugugacauaccacaauguucagaaguagaauguaugacaugcaauggagaaucguauagagguccaauggaccauacagaaucaggaaaaacaugucaaagaugggaucaacaaaccccacaucgacauaaauucuuaccagaacgauauccagacaaaggguucgacgauaauuauugcagaaauccagaugggaaaccaagacccugguguuacacucuagaccccgauacaccaugggaauauugugcaauaaaaacaugcgcacacucagcaguaaaugagacugaugucccaauggaaacuacagaaugcauucaaggacaaggugaagguuaccgaggcacaaguaauacuauauggaaugggauaccaugucaaagaugggacagucaauacccacauaaacaugauauaacgccagaaaauuuuaaauguaaagauuuaagagaaaauuauugcagaaauccugauggcgcggaaaguccauggugcuucacaacugauccuaacauaagaguugguuauugcagucaaauaccuaaaugcgauguaucauccggacaagauuguuauagggguaauggaaaaaauuauaugggcaauuuaucaaaaacacguaguggauuaacauguucaaugugggauaaaaauauggaagauuuacaucgacacauuuucugggaacccgaugcuaguaaauuaaacaaaaacuauugucgaaacccagaugaugaugcacauggaccauggugcuauacagguaacccacuuauaccaugggacuauuguccuauaucaagaugugaaggcgauacaacaccuacuauagucaauuuagaucauccuguaaucaguugcgcuaaaacaaaacaauuaagaguuguaaacggaauuccaacacaaacaacaguaggauggaugguaucacucaaauaccgaaauaaacacauaugcggagguucuuuaauaaaagaaagcuggguauuaaccgcaagacaaugcuucccggcaagaaauaaagauuuaaaagauuaugaagcaugguuaggaauacacgauguacacgaaaggggagaagaaaaaagaaaacaaauacuaaauauaucacaauuaguauacggcccagaagggagcgaucuaguucuucuaaaauuagccagaccagcaauauuagauaauuuuguaucuacuaucgaucuaccaucauauggauguacaauaccugagaaaacaacauguucaauauauggauggggauauacuggauuaauaaacgccgauggacuucuuagaguagcacacuuauauauaaugggaaacgaaaaaugcucacaacaucaucaaggaaaaguuacacuaaacgaaucagaacuaugugcuggcgcagaaaaaaucggaucaggcccaugcgaaggugauuacggcggaccacuuauaugugaacaacauaaaaugcgcaugguauuaggagucauaguucccggucggggcugugcgauaccaaacagaccaggcauauuuguccguguagccuacuaugcaaaauggauacauaaaguaauauuaacauauaaauuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5364 - RNA, 865 nt, Artificial Sequence
  mRNA product Design1 comprising derived and/or modified sequence from Homo sapiens__NP_002119.1__HsHMGB1 (opt12)
gggagaaagcuuaccaugggaaaaggagacccaaaaaaaccaagaggaaaaaugucaagcuacgcauucuucguacaaacaugcagagaagaacacaaaaaaaaacacccagacgcaagcguaaacuucagcgaauucagcaaaaaaugcucagaaagguggaaaacaaugagcgcaaaagagaaaggaaaauucgaagacauggcaaaagcagacaaagcaagauacgaaagagaaaugaaaacauacauaccaccaaaaggagaaacaaaaaaaaaauuuaaagacccaaacgcaccaaaaagaccaccaucagcauucuuccuauucugcagugaauacagaccaaaaauaaaaggagaacacccaggacuaagcauaggagacguagcaaaaaaauuaggagaaauguggaacaacacagcagcagacgacaaacaaccauacgaaaaaaaagcagcaaaauuaaaagaaaaauacgaaaaggacauagcagcauaucgagcaaaaggaaaaccagacgcagcaaaaaaaggaguaguaaaagcagaaaaaagcaaaaaaaaaaaagaagaagaagaagacgaagaagacgaagaagacgaagaagaagaagaagacgaagaagacgaagacgaagaagaagacgacgacgacgaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5365 - RNA, 862 nt, Artificial Sequence
  mRNA product Design1 comprising derived and/or modified sequence from Mus musculus__NP_001273985.1__MmVEGFA (opt12)
gggagaaagcuuaccaugaacuuccuacuaucauggguacacuggacacuagcauuacuacuauacuuacaccacgcaaaauggucacaagcagcaccaacaacagaaggagaacaaaaaucacacgaaguaauaaaauucauggacguauaccaacgaucauacugcagaccaauagaaacacuaguagacauauuccaagaauacccagacgaaauagaauacauauucaaaccaucaugcguaccauuaaugagaugcgcaggaugcugcaacgacgaagcauuagaaugcguaccaacaucagaaucaaacauaacaaugcaaauaaugagaauaaaaccacaccaaucacaacacauaggagaaaugucauuccuacaacauucaagaugcgaaugcagaccaaaaaaagacagaacaaaaccagaaaaaaaaucaguaagaggaaaaggaaaaggacaaaaaagaaaaagaaaaaaaucaagauucaaaucauggucaguacacugcgaaccaugcucagaacgaagaaaacacuuauuuguacaagacccacaaacaugcaaaugcucaugcaaaaacacagacucaagaugcaaagcaagacaacuagaacuaaaugaaagaacaugcagaugugacaaaccaagacgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5366 - RNA, 847 nt, Artificial Sequence
  mRNA product Design1 comprising derived and/or modified sequence from Homo sapiens__NP_061986.1__HsFGF21(L126R,P199G,A208E) (opt13)
gggagaaagcuuaccauggacucagacgaaacaggauuugaacacucaggacuauggguaucaguacuagcaggauuauuacuaggagccugccaagcacacccaauaccagacucaucaccauuauuacaauucggaggacaaguuagacaaagauaucuauauacagaugacgcacaacaaacagaagcacacuuagaaauaagagaagacggaacaguaggaggagcagcagaccaaucaccagaaucccuacuacaauuaaaagcacuaaaaccaggaguaauacaaauauuaggaguaaaaacaucaagauuccuaugccaaagaccagacggagcacuauacggcucacuacacuuugacccagaagcaugcucauucagagaaagacuacuagaagacggauauaauguauaucaaucagaagcacacggacuaccuuuacauuuaccaggaaacaaaucaccacacagagacccagcaccaagaggcccagcacgcuuuuuaccauuaccaggacuaccaccagcauuaccagaaccaccaggaauacuagcaccacaaccaccagauguuggaagcucagacccacuaucaaugguaggaggaucacaaggaagaucaccaucauaugaaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5367 - RNA, 2404 nt, Artificial Sequence
  mRNA product Design1 comprising derived and/or modified sequence from Mus musculus__NP_001276387.1__MmHGF (opt13)
gggagaaagcuuaccaugauguggggaacaaaacuuuuaccuguucuauuauuacaacacguccuguuacacuuauuauuacuacauguagccauaccuuacgcagaaggacaaaagaaacgaagaaacacacuucaugaauuuaagaaauccgcaaaaacaacauuaacaaaagaagauccauuauuaaaaauaaaaacaaagaaaguuaauucagcagaugaaugugcaaauagauguauaagaaacagaggauuuaccuuuacauguaaagcauuuguauucgacaaaucaaggaaacgauguuacugguauccauucaauaguaugaguucuggaguaaagaaaggauucggucaugaguucgaccuauaugaaaauaaagacuauauuagaaauuguauaaucggcaaaggugggucuuauaaaggcacuguuaguauaacaaaaucaggaauaaaaugucaaccauggaauagcaugauaccacacgaacacucauuucucccaucuucauacaggggcaaagaccuacaagaaaauuauuguagaaacccaaggggagaagaaggaggcccaugguguuuuacaucgaauccugaaguacgauaugaaguaugugacaucccccaaugcagugaaguagaauguaugacuuguaauggugaaucauaccgaggaccuauggaccauacagaaucaggaaaaacuugccaacgaugggaucaacaaaccccucaucgacacaaauuuuuaccagaacguuacccagauaaaggauuugacgauaauuacuguagaaauccagacgguaaaccucgacccugguguuacacucuugauccagauacaccaugggaauauugcgcaauaaaaacuugcgcacauucugcaguaaaugaaacagacguuccaauggaaacuaccgaauguauacaaggccaaggagaaggcuauagagguacaucaaauacaauauggaauggcauacccugccaaaggugggacucucaauauccacauaaacaugauauaacaccagaaaacuuuaaauguaaagauuuaagagaaaauuacuguagaaauccggauggagcagaaucucccugguguuucacuaccgauccuaacauaagaguaggauauuguagccaaauaccuaaaugugauguuagcucaggucaagacugcuacagagguaauggcaaaaauuacauggggaaucucaguaaaacacguaguggacucacauguucaaugugggauaaaaauauggaagaccugcacagacauauauucugggaaccugaugcuucaaaauuaaauaaaaauuauugcagaaauccagaugaugacgcucacggaccaugguguuacacugguaauccauuaauaccaugggauuauuguccaauaucaagaugcgaaggugauacaacuccaacaauaguaaaucuagaucauccaguaauauccugugcaaaaacaaaacaacuaagaguaguaaacggaauaccaacacaaacaacaguaggauggaugguuaguuuaaaauacagaaauaaacauauauguggaggauccuuaauaaaagaaucauggguauuaacugcaagacaauguuucccagcaaggaacaaagauuuaaaagauuacgaagcauggcuaggaauacaugauguucacgaaagaggagaagaaaaacguaaacaaauuuugaacauuucacaacuuguauacggcccagaaggaucugauuuaguauuauuaaaguuagcaagaccagcaauucucgauaauuucguaucaacgauagaucuccccaguuacggcuguacgauaccagaaaagacaacaugcaguauauacggauggggauauacaggacuaaucaacgcagauggacuuuuaagaguagcccacuuauauauaauggguaacgaaaaauguucacaacaucaucaaggaaaaguaacacuaaaugaaagcgaauuaugugcaggcgcagagaaaauaggaagcggaccuugugaaggcgauuacgguggaccacuaauaugugaacaacauaaaaugagaaugguauuaggaguaauaguuccaggacguggaugugccauaccaaaccgaccaggaauauuuguuaggguagccuacuacgcaaaauggauucacaaaguaauauuaacauauaaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5368 - RNA, 865 nt, Artificial Sequence
  mRNA product Design1 comprising derived and/or modified sequence from Homo sapiens__NP_002119.1__HsHMGB1 (opt13)
gggagaaagcuuaccaugggaaaaggagacccaaaaaaaccgagaggaaaaaugagcagcuacgcauuuuucguacaaacaugcagagaagaacacaaaaaaaaacacccagacgcaagcguaaacuuuagcgaauuuucaaaaaaaugcucagaaagauggaaaacaaugagcgcaaaagaaaaaggaaaauucgaagacauggcgaaagcagacaaagcaagauaugaaagagaaaugaaaacauacauaccaccaaaaggagaaaccaaaaaaaaauuuaaagacccaaacgcaccaaaaagaccaccaagcgcauucuuucuauucugcagugaauacagaccaaaaauaaaaggagaacacccaggauuaagcauaggagacguagcaaaaaaacuaggagaaauguggaacaacacagcagcagacgacaaacaaccauacgaaaaaaaagcagcaaaacuaaaagaaaaauacgaaaaagacauagcagcauauagagcaaaaggaaaaccagacgcagcaaaaaaaggaguaguaaaagcagaaaaaagcaaaaaaaaaaaagaagaagaagaagacgaagaagacgaagaagacgaagaagaagaagaagacgaagaagacgaagacgaagaagaagacgacgacgacgaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5369 - RNA, 862 nt, Artificial Sequence
  mRNA product Design1 comprising derived and/or modified sequence from Mus musculus__NP_001273985.1__MmVEGFA (opt13)
gggagaaagcuuaccaugaacuuccuacuaucauggguacacuggacacuagcacuacuacuauacuuacaccacgcaaaauggagucaagcagcaccaacaacagaaggagaacaaaaaagccacgaaguaauaaaauucauggacguauaucaacgaucauacugcagaccaauagaaacacuaguagauaucuuccaagaauacccagacgaaauagaauacauauucaaaccaucaugcguaccauuaaugagaugcgcaggaugcugcaacgacgaagcacuagaaugcguaccaacaucagaaucaaacauaacaaugcaaauaaugagaauaaaaccccaccaaagccaacacauaggagaaaugucauuccuacaacacucaagaugcgaaugcagacccaaaaaagaccgaacaaaaccagaaaaaaaaucaguaagaggaaaaggaaaaggacaaaaaagaaaacgaaaaaaaucacgauucaaaucauggucaguacacugcgaaccaugcucugaaagaagaaaacaccuauucguacaagacccacaaacauguaaaugcagcugcaaaaacacagacucaagaugcaaagcaagacaacuagaauuaaacgaaagaacaugcagaugcgacaaaccacgaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5370 - RNA, 1012 nt, Artificial Sequence
  mRNA product Design2 comprising derived and/or modified sequence from Homo sapiens__NP_061986.1__HsFGF21(L126R,P199G,A208E) (wt)
ggggcgcugccuacggagguggcagccaucuccuucucggcaucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5371 - RNA, 1012 nt, Artificial Sequence
  mRNA product Design2 comprising derived and/or modified sequence from Homo sapiens__NP_061986.1__HsFGF21(L126R,P199G,A208E) (wt)
ggggcgcugccuacggagguggcagccaucuccuucucggcaucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5372 - RNA, 2569 nt, Artificial Sequence
  mRNA product Design2 comprising derived and/or modified sequence from Mus musculus__NP_001276387.1__MmHGF (wt)
ggggcgcugccuacggagguggcagccaucuccuucucggcaucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaauuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauucccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcuuggcuuggcauccacgauguucaugagagaggcgaggagaagcgcaagcagaucuuaaacauuucccagcuggucuaugguccugaaggcucagacuugguuuuacugaagcuugcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5373 - RNA, 2569 nt, Artificial Sequence
  mRNA product Design2 comprising derived and/or modified sequence from Mus musculus__NP_001276387.1__MmHGF (wt)
ggggcgcugccuacggagguggcagccaucuccuucucggcaucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaacuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauccccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcauggcuuggcauccacgauguucaugagagaggcgaggagaagcgcaagcagaucuuaaacauuucccagcuggucuaugguccugaaggcucagacuugguuuuacugaagcuggcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5374 - RNA, 1030 nt, Artificial Sequence
  mRNA product Design2 comprising derived and/or modified sequence from Homo sapiens__NP_002119.1__HsHMGB1 (wt)
ggggcgcugccuacggagguggcagccaucuccuucucggcaucaagcuuaccaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaagcggacaaggcccguuaugaaagagaaaugaaaaccuauaucccucccaaaggggagacaaaaaagaaguucaaggaucccaaugcacccaagaggccuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaugaagaagaagaugaugaugaugaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5375 - RNA, 1027 nt, Artificial Sequence
  mRNA product Design2 comprising derived and/or modified sequence from Mus musculus__NP_001273985.1__MmVEGFA (wt)
ggggcgcugccuacggagguggcagccaucuccuucucggcaucaagcuuaccaugaacuuucugcucucuugggugcacuggacccuggcuuuacugcuguaccuccaccaugccaaguggucccaggcugcacccacgacagaaggagagcagaagucccaugaagugaucaaguucauggaugucuaccagcgaagcuacugccguccgauugagacccugguggacaucuuccaggaguaccccgacgagauagaguacaucuucaagccguccugugugccgcugaugcgcugugcaggcugcuguaacgaugaagcccuggagugcgugcccacgucagagagcaacaucaccaugcagaucaugcggaucaaaccucaccaaagccagcacauaggagagaugagcuuccuacagcacagcagaugugaaugcagaccaaagaaagacagaacaaagccagaaaaaaaaucaguucgaggaaagggaaagggucaaaaacgaaagcgcaagaaaucccgguuuaaauccuggagcguucacugugagccuuguucagagcggagaaagcauuuguuuguccaagauccgcagacguguaaauguuccugcaaaaacacagacucgcguugcaaggcgaggcagcuugaguuaaacgaacguacuugcagaugugacaagccaaggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5376 - RNA, 1012 nt, Artificial Sequence
  mRNA product Design2 comprising derived and/or modified sequence from Homo sapiens__NP_061986.1__HsFGF21(L126R,P199G,A208E) (opt1)
ggggcgcugccuacggagguggcagccaucuccuucucggcaucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcgccugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggggcucccagggccggagccccuccuacgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5377 - RNA, 2569 nt, Artificial Sequence
  mRNA product Design2 comprising derived and/or modified sequence from Mus musculus__NP_001276387.1__MmHGF (opt1) R4603
ggggcgcugccuacggagguggcagccaucuccuucucggcaucaagcuuaccaugauguggggcaccaagcugcuccccgugcugcugcuccagcacguccugcugcaccuccugcugcuccacguggccaucccguacgccgaggggcagaagaagcgccggaacacccugcacgaguucaagaagagcgcgaagacgacccugaccaaggaggacccccuccugaagaucaagaccaagaaggugaacuccgccgacgagugcgccaaccgcugcauccggaaccgcggcuucacguucaccugcaaggccuucgucuucgacaagagccggaagcgcugcuacugguaccccuucaacuccaugagcuccggggugaagaagggcuucgggcacgaguucgaccuguacgagaacaaggacuacauccggaacugcaucaucggcaagggcgggagcuacaagggcaccguguccaucaccaagagcgggaucaagugccagcccuggaacuccaugaucccgcacgagcacagcuuccuccccuccagcuaccgcggcaaggaccugcaggagaacuacugccggaacccccgcggggaggagggcggccccuggugcuucacguccaacccggagguccgguacgaggugugcgacaucccccagugcagcgagguggagugcaugaccugcaacggggaguccuaccgcggccccauggaccacaccgagagcgggaagaccugccagcggugggaccagcagacgccccaccgccacaaguuccugccggagcgguaccccgacaagggcuucgacgacaacuacugccgcaaccccgacggcaagccccggccguggugcuacacccucgaccccgacacccccugggaguacugcgccaucaagaccugcgcgcacuccgccgucaacgagacggacgugcccauggagaccaccgagugcauccaggggcagggcgagggguaccgcggcaccagcaacacgaucuggaacgggaucccgugccagcggugggacucccaguacccccacaagcacgacaucacccccgagaacuucaagugcaaggaccugcgcgagaacuacugccggaaccccgacggcgccgagagcccguggugcuucaccaccgaccccaacauccgcgugggcuacugcagccagauccccaagugcgacgucuccagcgggcaggacugcuaccgcggcaacgggaagaacuacaugggcaaccuguccaagacgcggagcgggcucaccugcuccaugugggacaagaacauggaggaccugcaccgccacaucuucugggagcccgacgccagcaagcugaacaagaacuacugccggaacccggacgacgacgcgcacggccccuggugcuacaccggcaacccccucaucccgugggacuacugccccaucucccgcugcgagggggacaccacgcccaccaucgugaaccuggaccaccccgugaucagcugcgccaagaccaagcagcugcgggucgugaacggcaucccgacccagacgaccgugggguggauggucucccucaaguaccgcaacaagcacaucugcggcgggagccugaucaaggaguccugggugcugaccgcccggcagugcuuccccgcccgcaacaaggaccucaaggacuacgaggccuggcugggcauccacgacgugcacgagcggggcgaggagaagcgcaagcagauccugaacaucagccagcucgucuacgggcccgagggcuccgaccuggugcugcucaagcuggcgcggcccgccauccuggacaacuucgugagcaccaucgaccucccguccuacgggugcacgauccccgagaagaccaccugcagcaucuacggcuggggcuacaccgggcugaucaacgccgacggccugcuccgcgucgcccaccuguacaucauggggaacgagaagugcucccagcaccaccagggcaaggugacccugaacgagagcgagcucugcgccggggcggagaagaucggcuccggccccugcgagggggacuacggcgggccccugaucugcgagcagcacaagaugcggaugguccugggcgugaucgugccggggcgcggcugcgccauccccaaccggcccggcaucuucguccgcguggccuacuacgccaaguggauccacaaggugauccugacguacaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5378 - RNA, 1030 nt, Artificial Sequence
  mRNA product Design2 comprising derived and/or modified sequence from Homo sapiens__NP_002119.1__HsHMGB1 (opt1)
ggggcgcugccuacggagguggcagccaucuccuucucggcaucaagcuuaccaugggcaagggggaccccaagaagccgcgcggcaagaugagcagcuacgccuucuucgugcagaccugccgggaggagcacaagaagaagcaccccgacgccagcgucaacuucuccgaguucagcaagaagugcuccgagcgcuggaagaccaugagcgcgaaggagaaggggaaguucgaggacauggccaaggccgacaaggcccgguacgagcgcgagaugaagacguacaucccgcccaagggcgagaccaagaagaaguucaaggaccccaacgcccccaagcggccgcccuccgcguucuuccuguucugcagcgaguaccgccccaagaucaagggggagcaccccggccucuccaucggcgacguggccaagaagcugggggagauguggaacaacaccgccgccgacgacaagcagcccuacgagaagaaggcggccaagcugaaggagaaguacgagaaggacaucgccgccuaccgggccaagggcaagcccgacgcggccaagaaggggguggucaaggccgagaaguccaagaagaagaaggaggaggaggaggacgaggaggacgaggaggacgaggaggaggaggaggacgaggaggacgaggacgaggaggaggacgacgacgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5379 - RNA, 1027 nt, Artificial Sequence
  mRNA product Design2 comprising derived and/or modified sequence from Mus musculus__NP_001273985.1__MmVEGFA (opt1)
ggggcgcugccuacggagguggcagccaucuccuucucggcaucaagcuuaccaugaacuuccugcucagcugggugcacuggacccuggcccugcuccuguaccugcaccacgcgaaguggucgcaggccgccccgacgaccgagggcgagcagaagagccacgaggucaucaaguucauggacguguaccagcggagcuacugccgccccaucgagacccucguggacaucuuccaggaguacccggacgagaucgaguacaucuucaagccgucgugcgucccccugaugcggugcgcggggugcugcaacgacgaggcccuggagugcgugccgacgagcgagagcaacaucaccaugcagaucaugcggaucaagccgcaccagucgcagcacaucggcgagaugagcuuccuccagcacagccgcugcgagugccggcccaagaaggaccggaccaagccggagaagaagucggugcgcggcaaggggaagggccagaagcggaagcggaagaagagccgcuucaagagcuggucgguccacugcgagccgugcagcgagcggcggaagcaccuguucgugcaggacccccagacgugcaagugcagcugcaagaacaccgacucgcgcugcaaggcccggcagcuggagcucaacgagcggaccugccgcugcgacaagccgcggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5380 - RNA, 1012 nt, Artificial Sequence
  mRNA product Design2 comprising derived and/or modified sequence from Homo sapiens__NP_061986.1__HsFGF21(L126R,P199G,A208E) (opt2)
ggggcgcugccuacggagguggcagccaucuccuucucggcaucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcgccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggcggcucccagggccgcucccccuccuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5381 - RNA, 2569 nt, Artificial Sequence
  mRNA product Design2 comprising derived and/or modified sequence from Mus musculus__NP_001276387.1__MmHGF (opt2)
ggggcgcugccuacggagguggcagccaucuccuucucggcaucaagcuuaccaugauguggggcaccaagcuccuccccguccuccuccuccagcacguccuccuccaccuccuccuccuccacgucgccauccccuacgccgagggccagaagaagcgccgcaacacccuccacgaguucaagaaguccgccaagaccacccucaccaaggaggacccccuccucaagaucaagaccaagaaggucaacuccgccgacgagugcgccaaccgcugcauccgcaaccgcggcuucaccuucaccugcaaggccuucgucuucgacaagucccgcaagcgcugcuacugguaccccuucaacuccauguccuccggcgucaagaagggcuucggccacgaguucgaccucuacgagaacaaggacuacauccgcaacugcaucaucggcaagggcggcuccuacaagggcaccgucuccaucaccaaguccggcaucaagugccagcccuggaacuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccccauggaccacaccgaguccggcaagaccugccagcgcugggaccagcagaccccccaccgccacaaguuccuccccgagcgcuaccccgacaagggcuucgacgacaacuacugccgcaaccccgacggcaagccccgccccuggugcuacacccucgaccccgacacccccugggaguacugcgccaucaagaccugcgcccacuccgccgucaacgagaccgacguccccauggagaccaccgagugcauccagggccagggcgagggcuaccgcggcaccuccaacaccaucuggaacggcauccccugccagcgcugggacucccaguacccccacaagcacgacaucacccccgagaacuucaagugcaaggaccuccgcgagaacuacugccgcaaccccgacggcgccgagucccccuggugcuucaccaccgaccccaacauccgcgucggcuacugcucccagauccccaagugcgacgucuccuccggccaggacugcuaccgcggcaacggcaagaacuacaugggcaaccucuccaagacccgcuccggccucaccugcuccaugugggacaagaacauggaggaccuccaccgccacaucuucugggagcccgacgccuccaagcucaacaagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccagaccaccgucggcuggauggucucccucaaguaccgcaacaagcacaucugcggcggcucccucaucaaggaguccuggguccucaccgcccgccagugcuuccccgcccgcaacaaggaccucaaggacuacgaggccuggcucggcauccacgacguccacgagcgcggcgaggagaagcgcaagcagauccucaacaucucccagcucgucuacggccccgagggcuccgaccucguccuccucaagcucgcccgccccgccauccucgacaacuucgucuccaccaucgaccuccccuccuacggcugcaccauccccgagaagaccaccugcuccaucuacggcuggggcuacaccggccucaucaacgccgacggccuccuccgcgucgcccaccucuacaucaugggcaacgagaagugcucccagcaccaccagggcaaggucacccucaacgaguccgagcucugcgccggcgccgagaagaucggcuccggccccugcgagggcgacuacggcggcccccucaucugcgagcagcacaagaugcgcaugguccucggcgucaucguccccggccgcggcugcgccauccccaaccgccccggcaucuucguccgcgucgccuacuacgccaaguggauccacaaggucauccucaccuacaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5382 - RNA, 1030 nt, Artificial Sequence
  mRNA product Design2 comprising derived and/or modified sequence from Homo sapiens__NP_002119.1__HsHMGB1 (opt2)
ggggcgcugccuacggagguggcagccaucuccuucucggcaucaagcuuaccaugggcaagggcgaccccaagaagccccgcggcaagauguccuccuacgccuucuucguccagaccugccgcgaggagcacaagaagaagcaccccgacgccuccgucaacuucuccgaguucuccaagaagugcuccgagcgcuggaagaccauguccgccaaggagaagggcaaguucgaggacauggccaaggccgacaaggcccgcuacgagcgcgagaugaagaccuacaucccccccaagggcgagaccaagaagaaguucaaggaccccaacgcccccaagcgcccccccuccgccuucuuccucuucugcuccgaguaccgccccaagaucaagggcgagcaccccggccucuccaucggcgacgucgccaagaagcucggcgagauguggaacaacaccgccgccgacgacaagcagcccuacgagaagaaggccgccaagcucaaggagaaguacgagaaggacaucgccgccuaccgcgccaagggcaagcccgacgccgccaagaagggcgucgucaaggccgagaaguccaagaagaagaaggaggaggaggaggacgaggaggacgaggaggacgaggaggaggaggaggacgaggaggacgaggacgaggaggaggacgacgacgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5383 - RNA, 1027 nt, Artificial Sequence
  mRNA product Design2 comprising derived and/or modified sequence from Mus musculus__NP_001273985.1__MmVEGFA (opt2)
ggggcgcugccuacggagguggcagccaucuccuucucggcaucaagcuuaccaugaacuuccuccucuccuggguccacuggacccucgcccuccuccucuaccuccaccacgccaaguggucccaggccgcccccaccaccgagggcgagcagaagucccacgaggucaucaaguucauggacgucuaccagcgcuccuacugccgccccaucgagacccucgucgacaucuuccaggaguaccccgacgagaucgaguacaucuucaagcccuccugcgucccccucaugcgcugcgccggcugcugcaacgacgaggcccucgagugcguccccaccuccgaguccaacaucaccaugcagaucaugcgcaucaagccccaccagucccagcacaucggcgagauguccuuccuccagcacucccgcugcgagugccgccccaagaaggaccgcaccaagcccgagaagaaguccguccgcggcaagggcaagggccagaagcgcaagcgcaagaagucccgcuucaaguccugguccguccacugcgagcccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5384 - RNA, 1012 nt, Artificial Sequence
  mRNA product Design2 comprising derived and/or modified sequence from Homo sapiens__NP_061986.1__HsFGF21(L126R,P199G,A208E) (opt3)
ggggcgcugccuacggagguggcagccaucuccuucucggcaucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugagagauuacuggaagauggguauaacgucuaccagagcgaggcacacggacuucccuugcaucugccugguaauaaaaguccacacagggaccccgccccucggggcccagcucgcuuucuaccgcuccccgggcugccuccagcccuucccgaaccuccaggcauucuggcgccccagccgccugaugugggauccucugaccccuugagcaugguuggugggucccagggaagaucaccaaguuaugagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5385 - RNA, 2569 nt, Artificial Sequence
  mRNA product Design2 comprising derived and/or modified sequence from Mus musculus__NP_001276387.1__MmHGF (opt3)
ggggcgcugccuacggagguggcagccaucuccuucucggcaucaagcuuaccaugauguggggcaccaagcugcuccccgugcuucuguugcagcacgucuuacugcaucuacuccugcuucacguugccaucccuuacgcugaggggcaaaagaagagaaggaacacacugcaugaguucaaaaagagcgcaaaaacuacguugaccaaggaggacccacuccugaagauuaaaacaaagaaaguaaauuccgccgaugaaugcgcgaaccgguguauacgcaaucgaggauuuacuuuuaccugcaaggcuuucguguucgacaaaucucguaagagauguuauugguacccguuuaacucaaugaguagcggugugaagaaaggcuucgggcacgaguuugaucuguaugaaaauaaggacuacaucaggaacugcauuaucggaaaaggcgguuccuauaaggggacagucucuauuaccaaaucgggaaucaagugucagcccuggaacucaaugauaccucaugagcacagcuuccucccaaguuccuaccggggcaaagauuuacaggagaauuauugccgcaaucccagaggcgaagaagggggaccuugguguuuuacuucuaacccagaagugagguacgagguuugcgacaucccccaguguagcgagguggaaugcaugacauguaauggugaguccuaccggggcccuauggaucacaccgaaucagggaagacgugccaacgcugggaccagcagacuccacaucgacacaaguuccugccggagagauaucccgauaaaggauuugacgauaacuacugcaggaauccugacggcaagccacggcccugguguuauacccuugauccugacacaccaugggaauacugcgccauuaaaacuugugcacauagugccgucaacgagaccgacgugcccauggagacaaccgaaugcauccagggucaaggggagggauaucguggcacgagcaauacuauuuggaacggcaucccgugucagcgcugggauucucaguacccucacaagcacgacauaacacccgaaaacuucaaaugcaaggauuugagagagaauuauuguaggaacccagacggggcugaauccccuuggugcuuuaccacugaucccaauauucggguaggauacuguucacagaucccaaagugcgacguuagcaguggucaagauuguuaccgaggcaacgggaaaaauuauaugggaaaccugucuaagacacgcuccggccuaaccugcagcaugugggacaaaaauauggaggaucuccauagacacauuuucugggagcccgacgcaucgaagcugaacaaaaauuacugcaggaacccugaugacgacgcccaugguccaugguguuauacggggaauccgcuuauccccugggauuacugcccuaucucucggugugaaggcgacaccacaccaacuauugugaaccuggaucaccccgucauauccugcgcuaagaccaagcaguugcgcguggugaauggaaucccuacacagacuaccgucggcuggaugguuucacucaaauauagaaacaagcauauuugugggggaagucugaucaaagagagcuggguguuaacagccaggcaaugcuucccagcgcguaauaaggaccugaaagauuacgaagcauggcucgguauacacgacguacacgagcggggcgaagagaagcgaaagcagauucuuaacaucucccagcugguguaugggcccgagggaucugauuugguccuacugaaacucgccagaccggcuauccuggacaacuuugugagcaccauugaucuuccuucauacggcuguacuaucccagaaaagacgacaugcaguauuuacgguuggggguauaccggccugauaaaugccgacggauugcucaggguugcacaucuguacaucaugggcaacgagaaauguucccagcaccaucaagggaaggugacuuuaaaugaaagcgagcugugcgcuggagccgagaaaauugguucuggccccugugaaggggauuauggaggcccucuaaucugcgagcagcacaagaugcgcaugguccucggugugaucguacccgggcggggcugcgcgauuccaaacagaccuggaauauucguuaggguggccuacuaugcaaaauggauccacaaggucauucugaccuacaaacuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5386 - RNA, 1030 nt, Artificial Sequence
  mRNA product Design2 comprising derived and/or modified sequence from Homo sapiens__NP_002119.1__HsHMGB1 (opt3)
ggggcgcugccuacggagguggcagccaucuccuucucggcaucaagcuuaccaugggcaagggggaccccaaaaagccuagaggaaaaaugagcuccuacgccuucuuugugcagaccugcagggaggaacacaagaaaaagcauccagaugcuucugucaacuucucagaguuuaguaagaaauguagcgaacgguggaagacaauguccgcaaaagagaaggguaaauucgaagacauggccaaggcggauaaggcucgcuaugagcgagagaugaaaacuuacaucccgcccaagggcgaaacgaaaaagaaauuuaaggacccuaaugccccaaaacgucccccuucugcauucuuucuguucugcucggaguauagaccaaagauuaagggggaacaccccggacucucaauaggcgauguugccaagaaacuuggugagauguggaacaauaccgcugcagacgauaaacaaccuuacgagaagaaagccgcuaagcugaaggaaaaauaugagaaggacaucgccgcguacagggcaaaagggaagccagaugccgcuaaaaagggagugguaaaggccgagaaaagcaagaaaaagaaagaagaagaggaggacgaagaggaugaagaggacgaagaggaggaagaggaugaagaggacgaagacgaggaggaagaugacgaugacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5387 - RNA, 1027 nt, Artificial Sequence
  mRNA product Design2 comprising derived and/or modified sequence from Mus musculus__NP_001273985.1__MmVEGFA (opt3)
ggggcgcugccuacggagguggcagccaucuccuucucggcaucaagcuuaccaugaacuuccugcucagcugggugcacuggacccuugcccuguuguuauaccugcaucacgcuaaguggucccaggcagcccccacaacugagggcgaacaaaaaucucaugaggucaucaaguuuauggacguuuaucagagaucauacugcaggccuauugaaacgcuaguggauauauuccaggaguauccagacgaaaucgaguacauuuuuaaaccgaguuguguaccccucaugcggugcgcgggguguugcaaugaugaggcucuggaaugugugccuaccagcgaguccaacaucacaaugcagauuaugcgcaucaagccacaccaaucucagcauauaggagaaaugucguuccuucagcacucacgaugcgagugucgucccaaaaaggacagaacuaagccugagaaaaagagcgucagggguaaaggcaaggggcagaaacggaagcgcaagaaaaguagauuuaaguccuggucugugcacugcgaaccauguagcgagaggcggaaacaucuguucguucaagauccccagaccugcaaguguuccugcaaaaauacagacucacgcugcaaggcccgacaguuggaacucaacgagagaaccuguaggugcgauaaaccucggcguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5388 - RNA, 1012 nt, Artificial Sequence
  mRNA product Design2 comprising derived and/or modified sequence from Homo sapiens__NP_061986.1__HsFGF21(L126R,P199G,A208E) (opt4)
ggggcgcugccuacggagguggcagccaucuccuucucggcaucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagagacugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggcggcagccagggcagaagccccagcuacgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5389 - RNA, 2569 nt, Artificial Sequence
  mRNA product Design2 comprising derived and/or modified sequence from Mus musculus__NP_001276387.1__MmHGF (opt4)
ggggcgcugccuacggagguggcagccaucuccuucucggcaucaagcuuaccaugauguggggcaccaagcugcugcccgugcugcugcugcagcacgugcugcugcaccugcugcugcugcacguggccauccccuacgccgagggccagaagaagagaagaaacacccugcacgaguucaagaagagcgccaagaccacccugaccaaggaggacccccugcugaagaucaagaccaagaaggugaacagcgccgacgagugcgccaacagaugcaucagaaacagaggcuucaccuucaccugcaaggccuucguguucgacaagagcagaaagagaugcuacugguaccccuucaacagcaugagcagcggcgugaagaagggcuucggccacgaguucgaccuguacgagaacaaggacuacaucagaaacugcaucaucggcaagggcggcagcuacaagggcaccgugagcaucaccaagagcggcaucaagugccagcccuggaacagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccccauggaccacaccgagagcggcaagaccugccagagaugggaccagcagaccccccacagacacaaguuccugcccgagagauaccccgacaagggcuucgacgacaacuacugcagaaaccccgacggcaagcccagacccuggugcuacacccuggaccccgacacccccugggaguacugcgccaucaagaccugcgcccacagcgccgugaacgagaccgacgugcccauggagaccaccgagugcauccagggccagggcgagggcuacagaggcaccagcaacaccaucuggaacggcauccccugccagagaugggacagccaguacccccacaagcacgacaucacccccgagaacuucaagugcaaggaccugagagagaacuacugcagaaaccccgacggcgccgagagccccuggugcuucaccaccgaccccaacaucagagugggcuacugcagccagauccccaagugcgacgugagcagcggccaggacugcuacagaggcaacggcaagaacuacaugggcaaccugagcaagaccagaagcggccugaccugcagcaugugggacaagaacauggaggaccugcacagacacaucuucugggagcccgacgccagcaagcugaacaagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccacccagaccaccgugggcuggauggugagccugaaguacagaaacaagcacaucugcggcggcagccugaucaaggagagcugggugcugaccgccagacagugcuuccccgccagaaacaaggaccugaaggacuacgaggccuggcugggcauccacgacgugcacgagagaggcgaggagaagagaaagcagauccugaacaucagccagcugguguacggccccgagggcagcgaccuggugcugcugaagcuggccagacccgccauccuggacaacuucgugagcaccaucgaccugcccagcuacggcugcaccauccccgagaagaccaccugcagcaucuacggcuggggcuacaccggccugaucaacgccgacggccugcugagaguggcccaccuguacaucaugggcaacgagaagugcagccagcaccaccagggcaaggugacccugaacgagagcgagcugugcgccggcgccgagaagaucggcagcggccccugcgagggcgacuacggcggcccccugaucugcgagcagcacaagaugagaauggugcugggcgugaucgugcccggcagaggcugcgccauccccaacagacccggcaucuucgugagaguggccuacuacgccaaguggauccacaaggugauccugaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5390 - RNA, 1030 nt, Artificial Sequence
  mRNA product Design2 comprising derived and/or modified sequence from Homo sapiens__NP_002119.1__HsHMGB1 (opt4)
ggggcgcugccuacggagguggcagccaucuccuucucggcaucaagcuuaccaugggcaagggcgaccccaagaagcccagaggcaagaugagcagcuacgccuucuucgugcagaccugcagagaggagcacaagaagaagcaccccgacgccagcgugaacuucagcgaguucagcaagaagugcagcgagagauggaagaccaugagcgccaaggagaagggcaaguucgaggacauggccaaggccgacaaggccagauacgagagagagaugaagaccuacaucccccccaagggcgagaccaagaagaaguucaaggaccccaacgcccccaagagaccccccagcgccuucuuccuguucugcagcgaguacagacccaagaucaagggcgagcaccccggccugagcaucggcgacguggccaagaagcugggcgagauguggaacaacaccgccgccgacgacaagcagcccuacgagaagaaggccgccaagcugaaggagaaguacgagaaggacaucgccgccuacagagccaagggcaagcccgacgccgccaagaagggcguggugaaggccgagaagagcaagaagaagaaggaggaggaggaggacgaggaggacgaggaggacgaggaggaggaggaggacgaggaggacgaggacgaggaggaggacgacgacgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5391 - RNA, 1027 nt, Artificial Sequence
  mRNA product Design2 comprising derived and/or modified sequence from Mus musculus__NP_001273985.1__MmVEGFA (opt4)
ggggcgcugccuacggagguggcagccaucuccuucucggcaucaagcuuaccaugaacuuccugcugagcugggugcacuggacccuggcccugcugcuguaccugcaccacgccaaguggagccaggccgcccccaccaccgagggcgagcagaagagccacgaggugaucaaguucauggacguguaccagagaagcuacugcagacccaucgagacccugguggacaucuuccaggaguaccccgacgagaucgaguacaucuucaagcccagcugcgugccccugaugagaugcgccggcugcugcaacgacgaggcccuggagugcgugcccaccagcgagagcaacaucaccaugcagaucaugagaaucaagccccaccagagccagcacaucggcgagaugagcuuccugcagcacagcagaugcgagugcagacccaagaaggacagaaccaagcccgagaagaagagcgugagaggcaagggcaagggccagaagagaaagagaaagaagagcagauucaagagcuggagcgugcacugcgagcccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5392 - RNA, 1012 nt, Artificial Sequence
  mRNA product Design2 comprising derived and/or modified sequence from Homo sapiens__NP_061986.1__HsFGF21(L126R,P199G,A208E) (opt5)
ggggcgcugccuacggagguggcagccaucuccuucucggcaucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagagacugcuugaagauggcuauaacguguaccaguccgaggcccacgggcugccccuccaucugccuggaaauaaaagcccgcaccgggaccccgcgccucgcggccccgccagauuucugccucuccccgggcugccgccugcccuucccgaaccucccggaauccuggcuccccagccuccggauguugggucuuccgacccccucagcauggugggcgggucucagggacgguccccuagcuaugagucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5393 - RNA, 2569 nt, Artificial Sequence
  mRNA product Design2 comprising derived and/or modified sequence from Mus musculus__NP_001276387.1__MmHGF (opt5)
ggggcgcugccuacggagguggcagccaucuccuucucggcaucaagcuuaccaugauguggggcaccaagcugcuccccgugcugcuucugcagcacguccuccugcaucuucugcuccugcacguugccaucccuuacgcugaggggcagaaaaagagacggaacacacugcaugaguucaaaaagagcgccaaaacgacccucacaaaggaagacccgcugcuuaagauuaaaaccaagaaagucaauuccgcggaugaaugcgcuaaccgcuguaucagaaaucggggauuuacauuuaccugcaaggccuucguguucgacaaaucucgcaagagauguuauugguaccccuuuaacagcauguccucuggcgugaagaaaggguucggacacgaguuugaucuguaugaaaauaaggacuacauucggaacugcaucauuggcaaagggggaagcuauaagggcacaguguccaucaccaaaucuggcaucaagugucaaccuuggaauagcaugauuccccaugagcacuccuuccucccuagcucuuaccgcgggaaagaucugcaggagaacuauugcagaaauccccggggagaagagggcgggccuugguguuuuacguccaacccggaaguucgcuacgaggugugcgacaucccccaguguagcgaggucgaaugcaugaccuguaauggagagucuuacagaggcccuauggaucacacagaauccgggaagaccugccaacggugggaccagcagacaccccaucgccacaaguuccuuccugagagauaucccgauaaaggauuugacgauaacuacugccggaauccggacggcaagccucgccccugguguuauacccuggauccugacacgcccugggaauacugcgccauuaaaacaugugcucauagcgccgugaacgagaccgacguucccauggagacaaccgaaugcauccagggccaaggggagggauauagaggcaccucuaauacaauuuggaacgggaucccuugucagcggugggauucccaguacccgcacaagcacgacauuacgcccgaaaacuucaaaugcaaggaucucagagagaauuauugucgcaacccugacggagcugaaagccccuggugcuuuaccacagauccuaauauccgggugggcuacuguucccagauccccaagugcgacgucucuagcgggcaagauuguuacagaggaaacggcaaaaauuauaugggcaaccuguccaagacccgcagcgggcugacaugcucuaugugggacaaaaauauggaggaucuccaucggcacauuuucugggagccggacgccuccaagcugaacaaaaauuacugcagaaacccugaugacgacgcgcauggacccugguguuauaccggcaauccucuuauccccugggauuacugcccuauuagccgcugugaaggggacacgacacccaccaucgugaaccuggaucacccggugauuucuugcgccaagaccaagcagcuccgggucguuaauggaaucccuacacagaccacagugggcuggauggugagccugaaauauagaaacaagcauaucugugggggcucccuuauuaaagagucuuggguccugacggcucgccaaugcuuccccgcccggaauaaggaccucaaagauuacgaggcuuggcugggaauccacgacgugcacgaaagaggcgaagagaagcgcaagcagauucugaacaucagccagcucguuuaugggcccgagggauccgaucuggugcuucugaaacucgcccggccugcgauucuggacaacuuugucagcaccaucgaucuuccgucuuacggcuguacaauccccgaaaagaccacaugcuccauuuacggguggggauauaccggccugaucaaugccgacgggcuccugagaguggcucaucuguacauuaugggcaacgagaaauguagccagcaccaucaaggaaagguuacgcucaaugaaucugagcugugcgccggcgcugagaaaaucggguccggaccuugugaaggcgauuaugggggaccccuuauuugcgagcagcacaagaugcggauggugcugggcgucaucgugccugggcgcggcugcgccauucccaacagaccuggaaucuucguccggguggccuacuaugcuaaauggauccacaagguuauucucaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5394 - RNA, 1030 nt, Artificial Sequence
  mRNA product Design2 comprising derived and/or modified sequence from Homo sapiens__NP_002119.1__HsHMGB1 (opt5)
ggggcgcugccuacggagguggcagccaucuccuucucggcaucaagcuuaccaugggcaagggggaccccaaaaagccuagaggaaaaaugagcuccuacgccuucuuugugcagaccugccgggaggaacacaagaaaaagcauccggaugcuucugucaacuucagcgaguuuuccaagaaauguucugaacgcuggaagacaaugagcgccaaagagaagggcaaauucgaagacauggcgaaggcugauaaggccagauaugagcgggagaugaaaacguacauucccccuaagggggaaaccaaaaagaaauuuaaggaccccaaugccccuaaaagacccccuuccgcuuucuuucuguucugcucugaguaucgcccgaagaucaagggagaacaccccggccucagcaucggggauguugccaaaaagcugggagagauguggaacaauacagcugccgacgauaaacaaccuuacgagaagaaagcggccaaacuuaaggaaaaguaugagaaggacauugcugccuaccgggcuaaaggcaagcccgaugccgcgaaaaagggcguggugaaggccgaaaaauccaagaaaaagaaagaggaagaggaggacgaagaggaugaagaggacgaagaggaggaagaggaugaagaggacgaagacgaggaggaagaugacgaugacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5395 - RNA, 1027 nt, Artificial Sequence
  mRNA product Design2 comprising derived and/or modified sequence from Mus musculus__NP_001273985.1__MmVEGFA (opt5)
ggggcgcugccuacggagguggcagccaucuccuucucggcaucaagcuuaccaugaacuuccugcucagcugggugcacuggacccuggcccuucugcucuaccugcaucacgcuaaguggucccaggccgcgcccacaacggagggcgaacaaaaaucucaugaggucaucaaguuuauggacguuuaucagagaagcuacugccggccuauugaaacccuuguggauaucuuccaggaguauccggacgaaauugaguacaucuuuaaacccuccugugugccucugaugcgcugcgcuggguguugcaaugaugaggcccucgaauguguccccacaucugagagcaacauuaccaugcagaucaugagaaucaagccucaccaaucccagcauauuggagaaaugucuuuccugcagcacagccggugcgagugucgccccaaaaaggacagaacaaagccugagaaaaaguccgugcggggcaaagggaagggacagaaacgcaagagaaagaaaagccgguuuaagucuugguccguucacugcgaaccguguagcgagcgcagaaaacaucuguucgugcaagauccccagaccugcaaguguucuugcaaaaauacagacucccggugcaaggcccgccagcucgaacugaacgagagaaccugucggugcgauaaaccucgcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5396 - RNA, 1012 nt, Artificial Sequence
  mRNA product Design2 comprising derived and/or modified sequence from Homo sapiens__NP_061986.1__HsFGF21(L126R,P199G,A208E) (opt6)
ggggcgcugccuacggagguggcagccaucuccuucucggcaucaagcuuaccauggauucagaugaaacaggauuugaacacucaggauuaugggucucaguuuuagcaggacuauuacuaggagcaugucaagcacauccaauaccagacucaagcccauuauuacaauuuggaggacaaguaagacaaagauauuuauauacagaugacgcacaacaaacagaagcacauuuagaaauaagagaagacggcacaguaggaggagcagcagaucaaucaccagaaucacuauuacaauuaaaagcauuaaaaccaggaguaauacaaauauuaggaguaaaaacaucaagauucuuaugccaaagaccugacggagcauuauaugguucacuacacuuugacccagaagcauguucauucagagaaagacuacuagaagacggauauaauguuuaccaaucugaagcacauggauuaccacuacacuuaccaggaaauaaaucaccacaccgagacccagcaccacgaggaccagcaagauuccuaccacuaccaggauuaccaccagcauuaccagaaccaccaggaauacuagcuccacaaccaccagacguaggauccucagauccauuaucaaugguaggaggaucucaagguagaagucccucauacgaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5397 - RNA, 2569 nt, Artificial Sequence
  mRNA product Design2 comprising derived and/or modified sequence from Mus musculus__NP_001276387.1__MmHGF (opt6)
ggggcgcugccuacggagguggcagccaucuccuucucggcaucaagcuuaccaugauguggggaacaaaacuauuaccaguauuauuauuacaacaugucuuauuacauuuacuucuacuacauguugcaauacccuaugccgaaggacaaaagaaaagaagaaacacucuucacgaguucaagaaaagcgcaaaaacaacauuaacaaaagaagacccacuacuaaaaauaaaaacaaagaaaguaaacucagcagaugaaugugccaacagauguauuagaaaccgggguuuuacuuuuacaugcaaagccuucguauucgauaaaucaaggaaaagaugcuacugguauccauucaauucaaugucauccggagucaagaaaggauucggccaugaauuugaccuauacgaaaauaaagauuauaucagaaacuguauaauaggaaaaggugguucauacaaaggaacaguaucaauaacaaaaagcgguauuaaaugucaacccuggaacucuaugauuccucaugaacauucauuuuuaccaucaucauacagagguaaagacuuacaagaaaauuacugcagaaauccaaggggagaagaaggcggaccauggugcuuuacaucaaaucccgaaguaagauaugaaguaugcgacauaccacaauguagugaaguugaauguaugacauguaauggagaaagcuacagagguccaauggaucauacagaaucaggaaaaacaugccaaagaugggaucaacaaacaccgcauagacauaaauuuuuaccagaaagauauccagauaaaggauucgaugacaauuacuguaggaaucccgacggaaaaccacgaccauggugcuauacacuagacccugauacuccaugggaauauugcgcuauaaaaacuugugcacauucagcaguaaacgaaaccgacguaccaauggaaaccacugaauguauacaagggcaaggagaaggauacagaggaacaucaaauacaauauggaacggaauacccugucaaagaugggauagccaauauccacauaaacacgacauaaccccagaaaacuuuaaauguaaagaucuaagagaaaauuacugcagaaaucccgauggcgcagaaucaccauggugcuucacaacagaucccaacauaagagucggauauugcucccagauuccuaaaugugauguaagcuccgggcaagacugcuaccgaggcaacgguaaaaauuacaugggaaacuuaaguaaaacaagaucaggauuaacaugcaguaugugggauaaaaauauggaggacuuacauagacauauauucugggaaccagaugcaucaaaacuuaacaaaaauuauugcagaaacccagacgacgaugcacacggaccaugguguuauacaggaaauccacuuauaccaugggacuauuguccaauaucacgaugcgaaggagauacaacaccaacaauaguaaacuuagaucauccaguaauaaguugcgcaaaaacuaaacaauuacgaguuguuaacggaauaccaacacaaacuacagucggauggaugguuucauuaaaauauagaaacaaacacauaugcggaggaucccuuauaaaagaauccuggguauuaacagcaagacaauguuuuccagccagaaauaaagaucucaaagacuacgaagcaugguuaggcauacacgauguacaugaacgaggagaagaaaaacgaaaacaaauauuaaauauaagccagcuaguuuauggaccagaaggaucggacuuaguacuauuaaaacuugcaagaccagcaauccuagacaauuuugucucaacaaucgacuuacccucauauggaugcacuauuccggagaaaacaacaugcuccauauacggauggggauauacaggauugauaaaugcagauggauuacuaagaguagcacaucuauacauaaugggaaaugaaaaauguucacaacaccaucaaggaaaaguaacacuaaacgaaagcgaauuaugugcaggcgcagagaaaauaggcaguggaccaugugaaggagauuacgguggaccacuaauaugcgaacaacauaaaaugagaaugguccuaggaguaauaguccccggaagaggaugugcaauaccaaaucgaccgggcauauuuguaagaguagcauacuacgcaaaauggauacacaaaguaauacuaacauacaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5398 - RNA, 1030 nt, Artificial Sequence
  mRNA product Design2 comprising derived and/or modified sequence from Homo sapiens__NP_002119.1__HsHMGB1 (opt6)
ggggcgcugccuacggagguggcagccaucuccuucucggcaucaagcuuaccaugggaaaaggagacccaaaaaaaccaagaggaaaaaugucaagcuacgcauucuucguacaaacaugcagagaagaacacaaaaaaaaacacccagacgcaagcguaaacuucagcgaauucagcaaaaaauguucagaaagauggaaaacaaugagcgcaaaagaaaaaggaaaauucgaagacauggcaaaagcagacaaagcaagauacgaaagagaaaugaaaacauacauaccaccaaaaggagaaacaaaaaaaaaauucaaagacccaaacgcgccaaaaagaccaccaucagcauucuucuuauucugcagugaauacagaccaaaaauaaaaggagaacacccaggacuaaguauaggagacguagcaaaaaaacuaggagaaauguggaacaacacagcagcagacgacaaacaaccauacgaaaaaaaagcagcaaaacuaaaagaaaaauacgaaaaagacauagcggcauacagagcaaaaggaaaaccagacgcagcaaaaaaaggaguaguaaaagcagaaaaaaguaaaaaaaaaaaagaagaagaagaagacgaagaagacgaagaagacgaagaagaagaagaagacgaagaagacgaagacgaagaagaagacgacgacgacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5399 - RNA, 1027 nt, Artificial Sequence
  mRNA product Design2 comprising derived and/or modified sequence from Mus musculus__NP_001273985.1__MmVEGFA (opt6)
ggggcgcugccuacggagguggcagccaucuccuucucggcaucaagcuuaccaugaacuuccuauuaagcuggguacacuggacacuagcacuacuacuauacuuacaccacgccaaauggagccaagcagcaccaacaacagaaggagaacaaaaaucacacgaaguaauaaaauucauggacguauaccaaagaucauacuguagaccaauagaaacacuaguagacauauuccaagaauacccagacgaaauagaauacauauucaaaccaucaugcguaccacuaaugagaugcgcaggaugcugcaacgacgaagcacuagaaugcguaccaacaucagaaucaaacauaacaaugcaaauaaugagaauaaaaccacaccaaagucaacacauaggagaaaugaguuuccuacaacacucaagaugcgaaugcagaccaaaaaaagacagaacaaaaccagaaaaaaaaucaguaagaggaaaaggaaaaggccaaaaaagaaaaagaaaaaaaucaagauucaaaagcuggucaguacacugugaaccauguucagaaagaagaaaacaccuauucguacaagacccacaaacaugcaaaugcaguugcaaaaacacagacucaagaugcaaagcaagacaacuagaauuaaaugaacgaacaugcagaugcgacaaaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5400 - RNA, 1012 nt, Artificial Sequence
  mRNA product Design2 comprising derived and/or modified sequence from Homo sapiens__NP_061986.1__HsFGF21(L126R,P199G,A208E) (opt7)
ggggcgcugccuacggagguggcagccaucuccuucucggcaucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagaggcugcuggaagauggguauaacguguaccagagugaggcccacggcuugccccuccaucugccagguaauaaaagcccgcaccgggaccccgcaccacgcgggcccgccagguuucugccacuccccggccugccgcccgccuugccagaacccccaggcauccuggcaccccagccaccggaugugggguccagcgacccccucaguauggucgguggcucccaggggcggagcccauccuaugagaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5401 - RNA, 2569 nt, Artificial Sequence
  mRNA product Design2 comprising derived and/or modified sequence from Mus musculus__NP_001276387.1__MmHGF (opt7)
ggggcgcugccuacggagguggcagccaucuccuucucggcaucaagcuuaccaugauguggggcaccaagcugcuccccgugcuguugcugcagcacguccuccugcauuugcugcuccugcacguggccaucccauacgcagaggggcagaaaaagaggcggaacacucugcaugaguucaaaaagagcgccaaaaccacgcucacuaaggaggacccgcuguugaagauuaaaaccaagaaaguaaauuccgcggaugaaugcgccaaccgcuguaucaggaaucgggguuuuaccuucacuugcaaggcauuuguguucgacaaaagucgcaagagguguuauugguaccccuuuaacagcauguccaguggcgucaaaaagggguucggccacgaguuugaucuguaugaaaauaaggacuacauucggaacugcaucauugguaaagggggcagcuauaagggcaccguguccaucacgaaaagcgggaucaagugucaaccauggaacuccaugauuccccaugagcacaguuuccucccaagcuccuaccgcgguaaagaucugcaggagaauuauugcaggaauccccggggcgaagaagggggcccaugguguuuuacuagcaacccggaagugcgcuacgaggucugcgacaucccccaguguagugagguggaaugcaugaccugcaauggugaguccuacagggggccaauggaucacacugaaagcggcaagaccugucaacggugggaccagcagacuccccaucgccacaaguuccugccagagagguaucccgauaaaggcuuugacgauaacuacugccggaauccggacgggaagccccgcccaugguguuauacguuggaucccgacacuccaugggaauacugcgccauuaaaaccugugcacauuccgccguaaacgagacugacgugcccauggagaccaccgaaugcauccagggucaaggcgagggguauaggggcaccaguaauacgauuuggaacgguaucccaugucagcggugggauagccaguacccgcacaagcacgacauuacccccgaaaacuucaaaugcaaggaucuccgcgagaauuauuguaggaacccagacggcgcggaaucccccuggugcuucacuaccgauccaaauauccgggucggguacugcagccagauccccaagugugacgugaguuccggccaagauugcuacagggggaacgguaaaaauuauaugggcaaccugagcaagacccgcagugggcugacuuguuccaugugggacaaaaauauggaggaucuccaucggcacaucuuuugggagccggacgccagcaagcugaacaaaaauuacugcaggaacccagaugacgacgcacauggccccugguguuauacggguaaucccuugauuccaugggauuacugccccauuagccgcugugaaggcgacaccacuccaaccaucgugaaccuggaucacccggucauuuccugcgccaagaccaagcagcuccgggugguaaaugggauccccacucagacgaccgugggcuggauggucagucugaaauauaggaacaagcauaucugugggggcagccugauuaaagaguccuggguguugacugcccgccaaugcuucccagcacggaauaaggaccucaaagauuacgaagccuggcuggguauccacgacgugcacgagaggggcgaagagaagcggaaacagauucugaacaucagccagcucgucuaugggcccgaggguagugaucugguguugcugaagcucgcgcgcccagccauucuggacaacuuuguauccaccaucgaucugcccagcuacggcuguacuaucccggaaaagaccacgugcuccauuuacggguggggcuauaccggguugaucaaugcagacggccuccugaggguggcccaucuguacauuauggguaacgagaaaugcagucagcaccaucaagggaaggucacucucaaugaaagcgagcugugugcaggcgccgagaaaaucggcuccgggccaugcgaaggugauuauggcgggcccuugauuugugagcagcacaagaugcggauggugcugggcgucaucgugccaggucgcgggugcgccauucccaacaggccgggcaucuucgugcggguagcguacuaugcaaaauggauccacaaggugauucucaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5402 - RNA, 1030 nt, Artificial Sequence
  mRNA product Design2 comprising derived and/or modified sequence from Homo sapiens__NP_002119.1__HsHMGB1 (opt7)
ggggcgcugccuacggagguggcagccaucuccuucucggcaucaagcuuaccaugggcaagggggaccccaaaaagccaagggguaaaaugagcuccuacgccuucuuugugcagaccugccgggaggaacacaagaaaaagcauccggaugcaagugucaacuucagcgaguuuuccaagaaauguagugaacgcuggaagacuaugagcgccaaagagaagggcaaauucgaagacauggcgaaggccgauaaagcaagguaugagcgggagaugaagaccuacauucccccaaagggggaaacgaaaaagaaauuuaaggaccccaaugccccaaaaaggcccccauccgcauucuuucuguucugcagcgaguaucgcccgaagaucaagggcgaacaccccggucucuccaucggggauguggccaaaaagcugggcgagauguggaacaauacugcggccgacgauaaacaaccauacgagaagaaagcagccaaguugaaggaaaaauaugagaaggacauugccgcauaccgggccaaaggcaagcccgaugcggccaaaaaggggguagugaaggcagagaaaaguaagaaaaagaaagaagaagaggaggacgaagaggaugaagaggacgaagaggaggaagaggaugaagaggacgaagacgaggaggaagaugacgaugacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5403 - RNA, 1027 nt, Artificial Sequence
  mRNA product Design2 comprising derived and/or modified sequence from Mus musculus__NP_001273985.1__MmVEGFA (opt7)
ggggcgcugccuacggagguggcagccaucuccuucucggcaucaagcuuaccaugaacuuccugcucagcugggugcacuggacccuggccuugcugcucuaccugcaucacgcaaaguggucccaggccgcgcccacuaccgagggcgaacagaaaagucaugaggucaucaaguuuauggacguguaucaaaggagcuacugccggccaauugaaacguugguagauaucuuccaggaguauccggacgaaauugaguacaucuuuaaacccuccugugugccacugaugcgcugcgccggguguugcaaugaugaggcacucgaauguguccccaccagugagagcaacauuacuaugcagaucaugaggaucaagccacaccaaucccagcauauuggugaaaugagcuuccugcagcacucccggugcgagugucgccccaaaaaggacaggaccaagccagagaaaaagagugugcggggcaaagggaagggccagaaacgcaagaggaaaaagagccgguuuaaguccuggagcgugcacugcgaaccguguagugagcgcaggaaacaucuguucguccaagauccccagacuugcaagugcuccuguaaaaauaccgacagccggugcaaggcccgccagcucgaacugaacgagaggacgugucggugcgauaaaccaaggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5404 - RNA, 1012 nt, Artificial Sequence
  mRNA product Design2 comprising derived and/or modified sequence from Homo sapiens__NP_061986.1__HsFGF21(L126R,P199G,A208E) (opt8)
ggggcgcugccuacggagguggcagccaucuccuucucggcaucaagcuuaccauggacucugacgaaaccggcuucgaacacuccggacucugggucuccguccucgccggccuccuccuaggcgccugccaagcccaccccauccccgacucauccccacuccuacaauucggcggccaaguccgucaacgcuaccucuauaccgaugacgcccaacaaaccgaagcccaccucgaaauccgcgaagacggaaccgucggcggcgccgcugaccaaucacccgaaucccuccuccaacucaaagcacucaaacccggcguaauccaaauccucggcguaaaaaccucacgauuucuaugucaaagacccgacggagcccuauacggcucucuacacuucgacccagaagcaugcuccuuccgcgaacgacuccucgaagacggauacaacgucuaccaaucagaagcccacggccuaccccuccaccuccccggcaacaaaucuccccaccgcgaccccgcaccccgcggccccgcccgcuuccucccccuccccggccuacccccagcccuacccgaaccacccggcauacucgcaccccaaccacccgacgucggcuccuccgacccccuauccauggucggcggcucccaaggccgcucccccucauacgaaucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5405 - RNA, 2375 nt, Artificial Sequence
  mRNA product Design2 comprising derived and/or modified sequence from Mus musculus__NP_001276387.1__MmHGF (opt8)
ggggcgcugccuacggagguggcagccaucuccuucucggcaucaagcuuaccaugauguggggcacgaaacugcucccaguauugcucuugcaacacguccuacuccaccuucuacugcuacacgucgcuauacccuaugccgaaggacaaaagaaacgucgcaacacccuacacgaauuuaagaaaagcgccaagaccacacucacuaaagaagauccccuacucaaaauaaagaccaaaaaggugaacucggcugacgaaugcgccaaccgaugcauccgaaacagaggcuucacuuuuaccugcaaagccuucguuuucgacaagagccgaaaacgaugcuacugguacccauucaacagcauguccuccgggguaaagaaaggcuucggacaugaguucgaucuauacgaaaauaaagacuacauaagaaacugcauaaucggcaaaggaggguccuacaaaggcacagucagcaucacaaagucagggaucaaaugccaacccuggaacuccaugauaccacacgagcacaguuuccucccuaguagcuaccgaggaaaagaccuccaggagaacuacugccgcaacccccgcggggaagaaggcggaccuuggugcuucacaagcaaccccgagguccgcuacgaggucugcgacaucccccaaugcagcgaagucgagugcaugaccuguaacggagaaucauaccgaggcccaauggaucacaccgaauccggaaaaacaugccaacgaugggaccaacaaacaccgcaccgacacaaguuccuccccgaacgguaccccgacaaaggauucgacgacaacuacugccgcaaccccgacggaaaaccacgaccauggugcuacacgcucgacccggacacccccugggaauacugcgccaucaaaaccugcgcacacucagcggugaacgaaaccgauguaccaauggaaacaaccgaaugcauccaaggacaaggagagggcuacaggggcacgucaaauaccaucuggaacggcauaccaugccagcgcugggacagucaguacccccacaaacacgacauaacccccgaaaacuucaaaugcaaagaccucagagaaaacuacugccgcaaccccgacggcgccgaaucccccugguguuucacaaccgacccaaacauccgcgugggcuacugcucacaaauccccaagugcgacguaucaagcggccaagacugcuaucgcgggaacggcaaaaacuacaugggaaaccucucaaagaccagaagcggccuaacaugcucaaugugggacaaaaacauggaggaccuccaccggcacaucuuuugggaacccgacgcuuccaaacucaacaaaaacuacugccgaaaccccgacgacgaugcacacggcccauggugcuacacaggcaacccccugauacccugggacuacugccccaucuccagaugcgagggcgacacaacaccgaccaucguaaaucucgaccaccccguaaucuccugcgccaaaacaaaacaacuaagggucgugaacggaauccccacccaaacaacagugggcuggauggucagccucaaauacagaaacaagcacaucugcggcggcucccucaucaaggaaagcuggguacuaacagccaggcaaugcuuccccgccagaaauaaagaucuaaaagacuacgaagccuggcuaggcauccaugacguccacgaacgcggcgaggagaaacgaaaacaaauucucaacaucucucaacucgucuauggaccagaagggagcgaccucguucuucugaaacucgcccggcccgcaaucuuagacaacuucgucagcacaaucgaccuccccucauacggaugcaccaucccagaaaagacaaccugcagcauauacggauggggcuacaccggccugaucaacgcagacggccuucucagagucgcccaucucuacaucaugggaaacgaaaaaugcagccaacaccaccaaggcaaaguaacgcucaacgaauccgaacucugcgccggagcagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5406 - RNA, 1030 nt, Artificial Sequence
  mRNA product Design2 comprising derived and/or modified sequence from Homo sapiens__NP_002119.1__HsHMGB1 (opt8)
ggggcgcugccuacggagguggcagccaucuccuucucggcaucaagcuuaccauggggaaaggggacccgaaaaagccaagaggaaagaugucgagcuaugccuuuuucgugcaaacgugcagggaagaacacaagaaaaagcacccggacgcgagcgugaacuuuagcgaguucucgaaaaagugcucagaaagguggaagaccaugagcgcgaaagaaaaagggaaauuugaagauauggcaaaagcggacaaggcaagguacgagcgagaaaugaagacauauaucccgccaaagggcgagacaaagaagaaauucaaagacccgaacgcgcccaagcgcccgccaucggccuuuuuccuauucugcagcgaguacaggcccaagauaaagggcgagcacccaggauugagcauaggcgaugucgcgaaaaagcuaggggaaauguggaacaacacggccgcggacgauaaacagccguaugaaaagaaagcggccaagcucaaggaaaaguacgagaaagauaucgcggccuauagagcgaaaggaaaaccggacgcggccaagaaagggguagugaaagcggaaaagagcaagaaaaagaaagaggaagaggaagaugaagaggacgaggaagacgaagaggaagaggaagaugaagaggacgaggacgaggaagaggacgaugacgaugaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5407 - RNA, 1027 nt, Artificial Sequence
  mRNA product Design2 comprising derived and/or modified sequence from Mus musculus__NP_001273985.1__MmVEGFA (opt8)
ggggcgcugccuacggagguggcagccaucuccuucucggcaucaagcuuaccaugaacuuccuccucuccuggguccacuggacccucgcccuccuccucuaccuucaccacgcaaaauggucccaagccgcccccaccaccgaaggagaacaaaaaucccacgaagucauaaaauucauggacguauaccaacgaucauacugccgacccaucgaaacccuagucgacaucuuccaagaauacccagacgaaaucgaauacauauucaaacccuccugcguaccccucaugcgcugcgccggcugcugcaacgacgaagcccuagaaugcgucccaacaucagaaucaaacaucaccaugcaaaucaugcgcaucaaaccacaccaaucccaacacauaggcgaaauguccuuccuccaacacucacgcugcgaaugccgccccaaaaaagaccgaaccaaacccgaaaaaaaaucaguccgaggcaaaggaaaaggccaaaaacgcaagcgcaaaaaaucccgcuucaaauccugguccguccacugcgaacccugcuccgaacgccgaaaacaccucuucguccaagacccacaaaccugcaaaugcuccugcaaaaacaccgacuccagaugcaaagcacgccaacucgaacucaacgaaagaaccugccgcugcgacaaaccccgccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5408 - RNA, 1012 nt, Artificial Sequence
  mRNA product Design2 comprising derived and/or modified sequence from Homo sapiens__NP_061986.1__HsFGF21(L126R,P199G,A208E) (opt9)
ggggcgcugccuacggagguggcagccaucuccuucucggcaucaagcuuaccauggacuccgacgaaaccggauucgaacacucaggccucugggucucaguccucgccggccuccuccucggagccugccaagcccacccaauccccgacuccucaccacuccuccaauucggcggccaaguccgacaacgauaccucuacaccgacgacgcccaacaaaccgaagcccaccucgaaauccgcgaagacggcacaguaggaggcgccgccgaccaaucacccgaaucccuacuccaacuaaaagcacucaaacccggcgucauccaaauacucggcgucaaaaccucaagauuccucugccaacgccccgacggcgcccucuacggcucccuccacuucgaccccgaagccugcuccuuccgcgaacgccuccucgaagacggcuacaacgucuaccaauccgaagcccacggccucccccuccaccucccaggcaacaaauccccacaccgcgaccccgcaccccgcggcccagcccgcuuccucccccuccccggacuacccccugcccuacccgaaccaccaggcauccucgcaccccaaccacccgacgucggcuccuccgacccccucucaaugguaggcggcucacaaggccgaucccccuccuacgaauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5409 - RNA, 2569 nt, Artificial Sequence
  mRNA product Design2 comprising derived and/or modified sequence from Mus musculus__NP_001276387.1__MmHGF (opt9)
ggggcgcugccuacggagguggcagccaucuccuucucggcaucaagcuuaccaugauguggggcacaaaacuccuuccgguacugcugcuacaacacgugcuucuccaccuccuucuacuccacgucgcaauccccuaugcagaagggcagaaaaagcgacgcaacacacuccacgaguucaagaaaucggccaaaacaacccuaaccaaagaggacccccuccucaaaaucaaaaccaagaaaguaaacuccgccgacgagugcgccaacagaugcauccgcaaccggggcuucaccuucacaugcaaagccuucguguucgauaaaagccgcaaacgaugcuacugguacccauucaacuccaugagcucgggaguuaagaaaggcuuuggccacgaauuugaccuauacgagaauaaagacuacauaagaaacugcaucaucgguaaaggcggcucauacaaagggaccguauccaucacaaaaagcggaauaaaaugccaaccguggaacucuaugauaccccacgaacacucauuccuaccauccucauaccgcggcaaagaccuacaagagaacuacugccgaaacccccgaggagaagaagggggaccauggugcuucaccucaaacccagagguacgguacgaagucugcgacaucccacaaugcagcgaaguagagugcaugaccuguaacggagaguccuaccggggaccaauggaccauaccgaaucgggaaaaacuugccaacgaugggaucaacaaacaccccaucgucacaaauuccuaccggaacgauacccagacaaaggauucgacgacaacuacugcagaaaucccgacgguaaacccagaccuuggugcuacacccuagaccccgacaccccaugggaauacugcgccauaaagaccugcgcacacucugccgucaacgagaccgacguccccauggaaacaaccgaaugcauacaggggcagggagagggcuaccgcggcaccagcaacaccaucuggaacgguauacccugccagcgaugggacagccaauacccccacaagcacgacauaaccccugagaacuucaagugcaaagaccuacgcgaaaacuacugccgaaacccagacggcgccgaaucaccaugguguuucacaacagacccaaacauccgcgucggcuacugcucccaaauacccaaaugcgacgucaguuccggacaagacugcuaccgaggcaacggaaagaacuacaugggaaaccucuccaaaacccguagcgguuuaacaugcuccaugugggacaagaacauggaagaccuacacagacauauauucugggaacccgacgcaagcaaacucaacaaaaauuacugccgcaaccccgacgacgaugcccauggccccuggugcuacaccggcaacccccugauccccugggacuacuguccaauaagccgaugcgagggggacaccaccccuaccaucgucaaccuggaccaccccgucaucuccugcgcaaaaaccaaacagcuccgaguagugaacggcaucccaacccagacaacggucggauggauggucucacuaaaauaccgaaacaaacacauaugcgguggaucccucaucaaagaaagcugggucuuaaccgcccgccaaugcuuccccgcacgaaacaaagaccuaaaagacuacgaagcauggcuaggcauccacgacguacacgaacgaggcgaagaaaaacgaaagcaaauccucaacaucucacaguuagucuacggaccagaagguucagaccucgugcuccuaaaguuagcccgccccgccauacuagacaacuucgucagcaccaucgaccuaccaucauacggaugcaccauaccagagaaaaccacaugcaguaucuacggcuggggcuacacgggccucaucaacgccgacggccuccuacgcguagcccaccucuauaucaugggcaacgaaaaaugcucacaacaccaccaagggaaaguaacacugaacgaauccgagcucugcgccggcgccgagaaaaucggauccggccccugcgaaggagacuacgggggaccacuaauaugcgaacagcacaagaugcgaaugguccucggagucaucguacccggccgaggcugcgcaauacccaaucgccccggcauauucguucgcguagccuacuacgcuaaauggauccacaaagucauacucaccuacaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5410 - RNA, 1030 nt, Artificial Sequence
  mRNA product Design2 comprising derived and/or modified sequence from Homo sapiens__NP_002119.1__HsHMGB1 (opt9)
ggggcgcugccuacggagguggcagccaucuccuucucggcaucaagcuuaccauggggaaaggggacccgaagaaaccaaggggaaaaaugucgagcuaugccuucuucgugcaaacgugcagggaggaacacaagaaaaagcacccagacgcgagcgugaacuuuagcgaguucucgaaaaagugcucggaaagguggaagacaaugagcgcgaaagagaaagggaaauuugaagauauggcgaaagcggacaaggccagguacgagcgagagaugaagaccuauaucccgcccaagggcgagacaaagaagaaauucaaagacccgaacgcgccaaagcgcccgcccucggcauuuuucuuguucuguagcgaguacaggccaaagaucaagggcgagcacccaggcuugagcauaggcgaugucgccaaaaagcucggggaaauguggaauaacacagcagcagacgauaaacagcccuaugaaaagaaagcggcaaagcucaaggaaaaguacgagaaagauaucgcggccuaucgcgcgaaagggaaaccggacgcggcaaagaaaggggucgugaaagcggaaaagagcaagaaaaagaaagaggaagaggaagaugaagaggacgaggaagaugaagaggaagaggaagaugaagaggacgaggacgaagaagaggacgaugacgaugaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5411 - RNA, 1027 nt, Artificial Sequence
  mRNA product Design2 comprising derived and/or modified sequence from Mus musculus__NP_001273985.1__MmVEGFA (opt9)
ggggcgcugccuacggagguggcagccaucuccuucucggcaucaagcuuaccaugaacuuccuccucuccuggguccacuggacacucgcccuccuccuauaccuacaccacgccaaauggagccaagccgcccccacaaccgaaggcgaacaaaaaucccacgaagucaucaaauucauggacgucuaccaacgcuccuacugccgccccaucgaaacccucgucgacaucuuccaagaauaccccgacgaaaucgaauacaucuucaaacccuccugcgucccccucaugcgcugcgccggcugcugcaacgacgaagcccucgaaugcguccccaccucagaaucaaacauaacaaugcaaaucaugcgcaucaaaccccaccaaucccaacacaucggagaaauguccuuccuccaacacucacgcugcgaaugccgcccaaaaaaagaccgcaccaaacccgaaaaaaaauccguacgcggcaaaggcaaaggccaaaaacgcaaacgcaaaaaaucccgcuucaaaucauggucaguccacugcgaacccugcagcgaacgacgcaaacaccucuucguccaagacccacaaacaugcaaaugcuccugcaaaaacacagacucgcgcugcaaagcccgccaacucgaacuaaacgaacgcaccugccgcugcgacaaaccccgacgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5412 - RNA, 1012 nt, Artificial Sequence
  mRNA product Design2 comprising derived and/or modified sequence from Homo sapiens__NP_061986.1__HsFGF21(L126R,P199G,A208E) (opt11)
ggggcgcugccuacggagguggcagccaucuccuucucggcaucaagcuuaccauggacuccgacgaaaccggcuucgaacacuccggccucugggucuccguccucgccggccuccuccuaggcgcaugccaagcccaccccauacccgacuccucaccccuccuccaauucggcggccaaguccgccaacgcuaccuauacaccgacgacgcccaacaaacagaagcccaccucgaaauccgagaagacggcacagucggcggcgccgccgaccaaagccccgaaucccuccuccaacucaaagcccucaaacccggcgucauccaaauccucggcgucaaaacaucccgcuuccuaugccaacgccccgacggcgcccucuacggcucacuccacuucgaccccgaagccugcuccuuccgcgaacgccuccucgaagacggcuacaacgucuaccaauccgaagcccacggccuaccccuacaccuccccggcaacaaauccccucaccgcgaccccgcaccccgcggccccgcccgcuuccuaccccuccccggccucccccccgcccuacccgaaccccccggcauccucgccccccaacccccagacgucggcuccucugacccccucuccauggucggcggcucccaaggccgcucacccuccuacgaauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5413 - RNA, 2569 nt, Artificial Sequence
  mRNA product Design2 comprising derived and/or modified sequence from Mus musculus__NP_001276387.1__MmHGF (opt11)
ggggcgcugccuacggagguggcagccaucuccuucucggcaucaagcuuaccaugauguggggaacaaaauuacuaccaguccuacuacuccaacacguccuacuccaccuacuacuacuccacgucgcaauccccuacgccgaaggacagaaaaagcgaagaaacacacuacacgaauuuaagaaaucagccaaaaccacccuaaccaaagaagacccccuacugaaaaucaaaacuaagaaagucaacuccgcagaugagugcgcaaaccgaugcauacgcaaccgcggcuucacauucacuugcaaagccuucguuuucgacaaaucacgaaaacgcugcuacugguaccccuuuaacucgaugagcucaggcgugaagaaaggcuucggccaugaguucgaccuauacgaaaauaaagauuacauacguaacugcaucaucggaaaagguggcagcuacaaaggcacugucucaauaacgaaaaguggcaucaaaugccaacccuggaacuccaugaucccucacgaacacucauuccuccccuccagcuacagagggaaagaccuacaagaaaacuacugccguaauccaagaggagaagaaggcggaccuuggugcuucaccuccaaccccgaaguaagauacgaagugugcgacauaccacaaugcuccgaagucgaaugcaugaccugcaacggcgaauccuaccgaggacccauggaccacaccgaaucagguaagaccugccaacgcugggaccaacaaacaccccacagacacaaauuccucccugaacgcuaccccgacaaaggcuucgacgacaacuacugcaggaacccagacgguaaaccccgacccugguguuacacccucgacccagauacacccugggaauacugcgccauaaaaacaugcgcacacuccgccgucaacgagacagacguccccauggaaaccaccgagugcauacaaggacaaggggaaggauacagaggaacaucaaacaccauuuggaacggcauacccugccaaagaugggacucccaguauccccacaaacacgacaucacaccagaaaacuucaaaugcaaggaccuacgagaaaacuacugccgcaacccagacggagcugaaucccccuggugcuucacaacagacccgaauauccgcgucggauacuguucgcaaaucccaaagugcgacgucagcucaggacaagacugcuacagaggaaacggcaagaacuauaugggcaaccuuucgaaaacacgcagcggccuaaccugcuccaugugggacaagaacauggaagaccuccaccggcacauauucugggaacccgacgcaaguaaacuuaacaaaaacuacugucgcaauccggacgacgacgcccacggcccuuggugcuacaccgguaacccccuaaucccgugggacuacugccccauaucccgaugcgaaggagauacaacacccaccaucgugaaccuagaccaccccgucaucucaugcgcuaaaacgaaacagcuccgagucgucaacggcaucccaacgcaaacgaccgucggauggauggucucccugaaauaccgcaacaaacacauaugcggcggaagccuaauaaaagaaagcuggguccuuacagcccggcaaugcuucccagcccguaacaaagaccucaaagacuacgaagccuggcucggcauccacgacguacaugaacgaggggaagaaaaacgcaaacaaauacucaacaucucccagcugguauacggcccggaaggaagcgaccucguccucuugaaacuagccagacccgccauacuagacaacuucgucagcaccaucgaccuccccucauacggcugcaccaucccagaaaagacaaccugcucaaucuacggcuggggcuacaccggacuaaucaacgccgacggacuccugcgggucgcccauuuguacaucaugggaaacgaaaaaugcucccaacaccaccaaggcaaagucacccugaacgaauccgaacucugcgcaggcgccgagaaaaucggaucaggacccugcgaaggggacuacgggggcccccucaucugcgagcaacauaaaaugcguauggugcuaggcgugaucguccccggacgcggaugcgccaucccgaaccgccccgggaucuucguccgcgucgccuacuacgccaaauggauacauaaagucauucucaccuacaagcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5414 - RNA, 1030 nt, Artificial Sequence
  mRNA product Design2 comprising derived and/or modified sequence from Homo sapiens__NP_002119.1__HsHMGB1 (opt11)
ggggcgcugccuacggagguggcagccaucuccuucucggcaucaagcuuaccauggggaaaggggacccgaaaaagccgaggggaaagaugucgagcuaugccuucuucgugcaaacgugcagggaggaacacaagaaaaagcacccggacgcgagcgugaacuucagcgaguucucgaaaaagugcucggaaagguggaagaccaugagcgcgaaagagaaagggaaauuugaagauauggcgaaagcggacaaggcaagguacgagcgagagaugaagacauauauaccaccaaagggcgagaccaagaaaaaguucaaggacccgaacgcgcccaagcgcccgccaucggccuuuuucuuguucuguagcgaguacaggcccaagaucaagggagagcacccgggcuugagcauaggcgacgucgcgaaaaagcucggggaaauguggaauaacacggccgcggacgauaaacagccauaugaaaagaaagcggccaagcuaaaggaaaaguacgagaaagauaucgcggcauaucgcgcgaaagggaaaccggacgcggccaagaaaggagucguaaaagcggaaaagagcaagaaaaagaaagaggaagaggaagaugaagaggacgaggaagaugaagaggaagaggaagaugaagaggacgaggacgaggaagaggacgaugacgaugaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5415 - RNA, 1027 nt, Artificial Sequence
  mRNA product Design2 comprising derived and/or modified sequence from Mus musculus__NP_001273985.1__MmVEGFA (opt11)
ggggcgcugccuacggagguggcagccaucuccuucucggcaucaagcuuaccaugaacuuccuccuauccuggguccacuggacacucgcccuccuccucuaccuccaccacgccaaauggucccaagcagcacccaccacagaaggcgaacaaaaaucccacgaagucaucaaguucauggacgucuaccaacgcucauacugccgccccaucgaaacacucguagacaucuuccaagaauaccccgacgaaaucgaauacaucuucaaacccuccugcgucccacuaaugcgcugcgccggaugcugcaacgacgaagcccucgaaugcgucccaaccuccgaauccaacaucaccaugcaaaucaugcgcaucaaaccccaccaaucccaacacaucggcgaaauguccuuccuccaacacucccgcugcgaaugccgccccaaaaaagaccgcaccaaacccgaaaaaaaaucaguccgcggcaaaggcaaaggucaaaaacgaaaacgcaaaaaaucacgcuucaaauccugguccguccacugcgaacccugcucagaacgacgcaaacaccucuucguccaagacccccaaaccugcaaaugcucaugcaaaaacaccgacucccgaugcaaagcccgccaacucgaacucaacgaacgaaccugccgcugcgacaaaccccgacgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5416 - RNA, 1012 nt, Artificial Sequence
  mRNA product Design2 comprising derived and/or modified sequence from Homo sapiens__NP_061986.1__HsFGF21(L126R,P199G,A208E) (opt12)
ggggcgcugccuacggagguggcagccaucuccuucucggcaucaagcuuaccauggacucugacgaaacagguuucgaacacucaggacuaugggucucaguauuagcaggacuauuauuaggagcaugucaagcacauccaauaccagacucaucaccacuacuacaauucggcggacaaguaagacaaagauacuuauacacagacgaugcacaacaaacagaagcacauuuagaaauaagagaagauggcacaguaggcggagcagcagaccaaucaccagaaucacuauuacaauuaaaagcauuaaaaccaggaguaauacaaauauuaggaguaaaaacaucaagauucuuaugucaaagaccugacggagcacuauacggaucacuacacuuugacccagaagcaugcucauuuagagaaagauuauuagaagacggauacaauguauaucaaucagaagcacacggauuaccauuacacuuacccggaaauaaaucaccacauagagacccagcaccaagaggaccugcaagauuucuaccucuaccaggacuaccaccagcacuaccugaaccaccaggaauauuagcaccacaaccaccagacguaggauccucagaccccuuaucaaugguaggcggaucacaaggaagaucaccaucauaugaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5417 - RNA, 2569 nt, Artificial Sequence
  mRNA product Design2 comprising derived and/or modified sequence from Mus musculus__NP_001276387.1__MmHGF (opt12)
ggggcgcugccuacggagguggcagccaucuccuucucggcaucaagcuuaccaugauguggggaacuaaauuacuaccaguucuauuacuucaacacguccuauuacauuuauuacuauuacacguugcaauaccauaugcagaaggacaaaaaaaaagaaggaacaccuuacacgaauuuaaaaaaucggcaaaaacaacccucacaaaggaagacccacuauuaaaaaucaaaacaaaaaaagugaauagugcagacgaaugugcaaauagaugcauaagaaacagaggauuuacauucacuuguaaagcauuuguauuugauaaaucaaggaaaagguguuauugguauccuuuuaacucaaugucuaguggaguaaaaaaaggauucggacaugaauuugaccuauaugaaaauaaagacuauauaagaaauugcauaauaggaaaagguggaucauauaaagggacaguuagcauaaccaaaucaggcauaaaaugucaaccauggaauucaaugauaccacaugaacauuccuuucuaccuaguaguuaucguggaaaagauuuacaagaaaauuauuguagaaacccaagaggagaagaaggagggccauggugcuuuacaagcaacccagaagucagauaugaaguaugugacauaccacaauguucagaaguagaauguaugacaugcaauggagaaucguauagagguccaauggaccauacagaaucaggaaaaacaugucaaagaugggaucaacaaaccccacaucgacauaaauucuuaccagaacgauauccagacaaaggguucgacgauaauuauugcagaaauccagaugggaaaccaagacccugguguuacacucuagaccccgauacaccaugggaauauugugcaauaaaaacaugcgcacacucagcaguaaaugagacugaugucccaauggaaacuacagaaugcauucaaggacaaggugaagguuaccgaggcacaaguaauacuauauggaaugggauaccaugucaaagaugggacagucaauacccacauaaacaugauauaacgccagaaaauuuuaaauguaaagauuuaagagaaaauuauugcagaaauccugauggcgcggaaaguccauggugcuucacaacugauccuaacauaagaguugguuauugcagucaaauaccuaaaugcgauguaucauccggacaagauuguuauagggguaauggaaaaaauuauaugggcaauuuaucaaaaacacguaguggauuaacauguucaaugugggauaaaaauauggaagauuuacaucgacacauuuucugggaacccgaugcuaguaaauuaaacaaaaacuauugucgaaacccagaugaugaugcacauggaccauggugcuauacagguaacccacuuauaccaugggacuauuguccuauaucaagaugugaaggcgauacaacaccuacuauagucaauuuagaucauccuguaaucaguugcgcuaaaacaaaacaauuaagaguuguaaacggaauuccaacacaaacaacaguaggauggaugguaucacucaaauaccgaaauaaacacauaugcggagguucuuuaauaaaagaaagcuggguauuaaccgcaagacaaugcuucccggcaagaaauaaagauuuaaaagauuaugaagcaugguuaggaauacacgauguacacgaaaggggagaagaaaaaagaaaacaaauacuaaauauaucacaauuaguauacggcccagaagggagcgaucuaguucuucuaaaauuagccagaccagcaauauuagauaauuuuguaucuacuaucgaucuaccaucauauggauguacaauaccugagaaaacaacauguucaauauauggauggggauauacuggauuaauaaacgccgauggacuucuuagaguagcacacuuauauauaaugggaaacgaaaaaugcucacaacaucaucaaggaaaaguuacacuaaacgaaucagaacuaugugcuggcgcagaaaaaaucggaucaggcccaugcgaaggugauuacggcggaccacuuauaugugaacaacauaaaaugcgcaugguauuaggagucauaguucccggucggggcugugcgauaccaaacagaccaggcauauuuguccguguagccuacuaugcaaaauggauacauaaaguaauauuaacauauaaauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5418 - RNA, 1030 nt, Artificial Sequence
  mRNA product Design2 comprising derived and/or modified sequence from Homo sapiens__NP_002119.1__HsHMGB1 (opt12)
ggggcgcugccuacggagguggcagccaucuccuucucggcaucaagcuuaccaugggaaaaggagacccaaaaaaaccaagaggaaaaaugucaagcuacgcauucuucguacaaacaugcagagaagaacacaaaaaaaaacacccagacgcaagcguaaacuucagcgaauucagcaaaaaaugcucagaaagguggaaaacaaugagcgcaaaagagaaaggaaaauucgaagacauggcaaaagcagacaaagcaagauacgaaagagaaaugaaaacauacauaccaccaaaaggagaaacaaaaaaaaaauuuaaagacccaaacgcaccaaaaagaccaccaucagcauucuuccuauucugcagugaauacagaccaaaaauaaaaggagaacacccaggacuaagcauaggagacguagcaaaaaaauuaggagaaauguggaacaacacagcagcagacgacaaacaaccauacgaaaaaaaagcagcaaaauuaaaagaaaaauacgaaaaggacauagcagcauaucgagcaaaaggaaaaccagacgcagcaaaaaaaggaguaguaaaagcagaaaaaagcaaaaaaaaaaaagaagaagaagaagacgaagaagacgaagaagacgaagaagaagaagaagacgaagaagacgaagacgaagaagaagacgacgacgacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5419 - RNA, 1027 nt, Artificial Sequence
  mRNA product Design2 comprising derived and/or modified sequence from Mus musculus__NP_001273985.1__MmVEGFA (opt12)
ggggcgcugccuacggagguggcagccaucuccuucucggcaucaagcuuaccaugaacuuccuacuaucauggguacacuggacacuagcauuacuacuauacuuacaccacgcaaaauggucacaagcagcaccaacaacagaaggagaacaaaaaucacacgaaguaauaaaauucauggacguauaccaacgaucauacugcagaccaauagaaacacuaguagacauauuccaagaauacccagacgaaauagaauacauauucaaaccaucaugcguaccauuaaugagaugcgcaggaugcugcaacgacgaagcauuagaaugcguaccaacaucagaaucaaacauaacaaugcaaauaaugagaauaaaaccacaccaaucacaacacauaggagaaaugucauuccuacaacauucaagaugcgaaugcagaccaaaaaaagacagaacaaaaccagaaaaaaaaucaguaagaggaaaaggaaaaggacaaaaaagaaaaagaaaaaaaucaagauucaaaucauggucaguacacugcgaaccaugcucagaacgaagaaaacacuuauuuguacaagacccacaaacaugcaaaugcucaugcaaaaacacagacucaagaugcaaagcaagacaacuagaacuaaaugaaagaacaugcagaugugacaaaccaagacgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5420 - RNA, 1012 nt, Artificial Sequence
  mRNA product Design2 comprising derived and/or modified sequence from Homo sapiens__NP_061986.1__HsFGF21(L126R,P199G,A208E) (opt13)
ggggcgcugccuacggagguggcagccaucuccuucucggcaucaagcuuaccauggacucagacgaaacaggauuugaacacucaggacuauggguaucaguacuagcaggauuauuacuaggagccugccaagcacacccaauaccagacucaucaccauuauuacaauucggaggacaaguuagacaaagauaucuauauacagaugacgcacaacaaacagaagcacacuuagaaauaagagaagacggaacaguaggaggagcagcagaccaaucaccagaaucccuacuacaauuaaaagcacuaaaaccaggaguaauacaaauauuaggaguaaaaacaucaagauuccuaugccaaagaccagacggagcacuauacggcucacuacacuuugacccagaagcaugcucauucagagaaagacuacuagaagacggauauaauguauaucaaucagaagcacacggacuaccuuuacauuuaccaggaaacaaaucaccacacagagacccagcaccaagaggcccagcacgcuuuuuaccauuaccaggacuaccaccagcauuaccagaaccaccaggaauacuagcaccacaaccaccagauguuggaagcucagacccacuaucaaugguaggaggaucacaaggaagaucaccaucauaugaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5421 - RNA, 2569 nt, Artificial Sequence
  mRNA product Design2 comprising derived and/or modified sequence from Mus musculus__NP_001276387.1__MmHGF (opt13)
ggggcgcugccuacggagguggcagccaucuccuucucggcaucaagcuuaccaugauguggggaacaaaacuuuuaccuguucuauuauuacaacacguccuguuacacuuauuauuacuacauguagccauaccuuacgcagaaggacaaaagaaacgaagaaacacacuucaugaauuuaagaaauccgcaaaaacaacauuaacaaaagaagauccauuauuaaaaauaaaaacaaagaaaguuaauucagcagaugaaugugcaaauagauguauaagaaacagaggauuuaccuuuacauguaaagcauuuguauucgacaaaucaaggaaacgauguuacugguauccauucaauaguaugaguucuggaguaaagaaaggauucggucaugaguucgaccuauaugaaaauaaagacuauauuagaaauuguauaaucggcaaaggugggucuuauaaaggcacuguuaguauaacaaaaucaggaauaaaaugucaaccauggaauagcaugauaccacacgaacacucauuucucccaucuucauacaggggcaaagaccuacaagaaaauuauuguagaaacccaaggggagaagaaggaggcccaugguguuuuacaucgaauccugaaguacgauaugaaguaugugacaucccccaaugcagugaaguagaauguaugacuuguaauggugaaucauaccgaggaccuauggaccauacagaaucaggaaaaacuugccaacgaugggaucaacaaaccccucaucgacacaaauuuuuaccagaacguuacccagauaaaggauuugacgauaauuacuguagaaauccagacgguaaaccucgacccugguguuacacucuugauccagauacaccaugggaauauugcgcaauaaaaacuugcgcacauucugcaguaaaugaaacagacguuccaauggaaacuaccgaauguauacaaggccaaggagaaggcuauagagguacaucaaauacaauauggaauggcauacccugccaaaggugggacucucaauauccacauaaacaugauauaacaccagaaaacuuuaaauguaaagauuuaagagaaaauuacuguagaaauccggauggagcagaaucucccugguguuucacuaccgauccuaacauaagaguaggauauuguagccaaauaccuaaaugugauguuagcucaggucaagacugcuacagagguaauggcaaaaauuacauggggaaucucaguaaaacacguaguggacucacauguucaaugugggauaaaaauauggaagaccugcacagacauauauucugggaaccugaugcuucaaaauuaaauaaaaauuauugcagaaauccagaugaugacgcucacggaccaugguguuacacugguaauccauuaauaccaugggauuauuguccaauaucaagaugcgaaggugauacaacuccaacaauaguaaaucuagaucauccaguaauauccugugcaaaaacaaaacaacuaagaguaguaaacggaauaccaacacaaacaacaguaggauggaugguuaguuuaaaauacagaaauaaacauauauguggaggauccuuaauaaaagaaucauggguauuaacugcaagacaauguuucccagcaaggaacaaagauuuaaaagauuacgaagcauggcuaggaauacaugauguucacgaaagaggagaagaaaaacguaaacaaauuuugaacauuucacaacuuguauacggcccagaaggaucugauuuaguauuauuaaaguuagcaagaccagcaauucucgauaauuucguaucaacgauagaucuccccaguuacggcuguacgauaccagaaaagacaacaugcaguauauacggauggggauauacaggacuaaucaacgcagauggacuuuuaagaguagcccacuuauauauaauggguaacgaaaaauguucacaacaucaucaaggaaaaguaacacuaaaugaaagcgaauuaugugcaggcgcagagaaaauaggaagcggaccuugugaaggcgauuacgguggaccacuaauaugugaacaacauaaaaugagaaugguauuaggaguaauaguuccaggacguggaugugccauaccaaaccgaccaggaauauuuguuaggguagccuacuacgcaaaauggauucacaaaguaauauuaacauauaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5422 - RNA, 1030 nt, Artificial Sequence
  mRNA product Design2 comprising derived and/or modified sequence from Homo sapiens__NP_002119.1__HsHMGB1 (opt13)
ggggcgcugccuacggagguggcagccaucuccuucucggcaucaagcuuaccaugggaaaaggagacccaaaaaaaccgagaggaaaaaugagcagcuacgcauuuuucguacaaacaugcagagaagaacacaaaaaaaaacacccagacgcaagcguaaacuuuagcgaauuuucaaaaaaaugcucagaaagauggaaaacaaugagcgcaaaagaaaaaggaaaauucgaagacauggcgaaagcagacaaagcaagauaugaaagagaaaugaaaacauacauaccaccaaaaggagaaaccaaaaaaaaauuuaaagacccaaacgcaccaaaaagaccaccaagcgcauucuuucuauucugcagugaauacagaccaaaaauaaaaggagaacacccaggauuaagcauaggagacguagcaaaaaaacuaggagaaauguggaacaacacagcagcagacgacaaacaaccauacgaaaaaaaagcagcaaaacuaaaagaaaaauacgaaaaagacauagcagcauauagagcaaaaggaaaaccagacgcagcaaaaaaaggaguaguaaaagcagaaaaaagcaaaaaaaaaaaagaagaagaagaagacgaagaagacgaagaagacgaagaagaagaagaagacgaagaagacgaagacgaagaagaagacgacgacgacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5423 - RNA, 1027 nt, Artificial Sequence
  mRNA product Design2 comprising derived and/or modified sequence from Mus musculus__NP_001273985.1__MmVEGFA (opt13)
ggggcgcugccuacggagguggcagccaucuccuucucggcaucaagcuuaccaugaacuuccuacuaucauggguacacuggacacuagcacuacuacuauacuuacaccacgcaaaauggagucaagcagcaccaacaacagaaggagaacaaaaaagccacgaaguaauaaaauucauggacguauaucaacgaucauacugcagaccaauagaaacacuaguagauaucuuccaagaauacccagacgaaauagaauacauauucaaaccaucaugcguaccauuaaugagaugcgcaggaugcugcaacgacgaagcacuagaaugcguaccaacaucagaaucaaacauaacaaugcaaauaaugagaauaaaaccccaccaaagccaacacauaggagaaaugucauuccuacaacacucaagaugcgaaugcagacccaaaaaagaccgaacaaaaccagaaaaaaaaucaguaagaggaaaaggaaaaggacaaaaaagaaaacgaaaaaaaucacgauucaaaucauggucaguacacugcgaaccaugcucugaaagaagaaaacaccuauucguacaagacccacaaacauguaaaugcagcugcaaaaacacagacucaagaugcaaagcaagacaacuagaauuaaacgaaagaacaugcagaugcgacaaaccacgaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5424 - RNA, 977 nt, Artificial Sequence
  mRNA product Design3 comprising derived and/or modified sequence from Homo sapiens__NP_061986.1__HsFGF21(L126R,P199G,A208E) (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5425 - RNA, 977 nt, Artificial Sequence
  mRNA product Design3 comprising derived and/or modified sequence from Homo sapiens__NP_061986.1__HsFGF21(L126R,P199G,A208E) (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5426 - RNA, 2534 nt, Artificial Sequence
  mRNA product Design3 comprising derived and/or modified sequence from Mus musculus__NP_001276387.1__MmHGF (wt)
gggagagucccgcagucggcguccagcggcucugcuuguucgugugugugucguugcaggccuuauucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaauuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauucccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcuuggcuuggcauccacgauguucaugagagaggcgaggagaagcgcaagcagaucuuaaacauuucccagcuggucuaugguccugaaggcucagacuugguuuuacugaagcuugcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5427 - RNA, 2534 nt, Artificial Sequence
  mRNA product Design3 comprising derived and/or modified sequence from Mus musculus__NP_001276387.1__MmHGF (wt)
gggagagucccgcagucggcguccagcggcucugcuuguucgugugugugucguugcaggccuuauucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaacuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauccccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcauggcuuggcauccacgauguucaugagagaggcgaggagaagcgcaagcagaucuuaaacauuucccagcuggucuaugguccugaaggcucagacuugguuuuacugaagcuggcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5428 - RNA, 995 nt, Artificial Sequence
  mRNA product Design3 comprising derived and/or modified sequence from Homo sapiens__NP_002119.1__HsHMGB1 (wt)
gggagagucccgcagucggcguccagcggcucugcuuguucgugugugugucguugcaggccuuauucaagcuuaccaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaagcggacaaggcccguuaugaaagagaaaugaaaaccuauaucccucccaaaggggagacaaaaaagaaguucaaggaucccaaugcacccaagaggccuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaugaagaagaagaugaugaugaugaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5429 - RNA, 992 nt, Artificial Sequence
  mRNA product Design3 comprising derived and/or modified sequence from Mus musculus__NP_001273985.1__MmVEGFA (wt)
gggagagucccgcagucggcguccagcggcucugcuuguucgugugugugucguugcaggccuuauucaagcuuaccaugaacuuucugcucucuugggugcacuggacccuggcuuuacugcuguaccuccaccaugccaaguggucccaggcugcacccacgacagaaggagagcagaagucccaugaagugaucaaguucauggaugucuaccagcgaagcuacugccguccgauugagacccugguggacaucuuccaggaguaccccgacgagauagaguacaucuucaagccguccugugugccgcugaugcgcugugcaggcugcuguaacgaugaagcccuggagugcgugcccacgucagagagcaacaucaccaugcagaucaugcggaucaaaccucaccaaagccagcacauaggagagaugagcuuccuacagcacagcagaugugaaugcagaccaaagaaagacagaacaaagccagaaaaaaaaucaguucgaggaaagggaaagggucaaaaacgaaagcgcaagaaaucccgguuuaaauccuggagcguucacugugagccuuguucagagcggagaaagcauuuguuuguccaagauccgcagacguguaaauguuccugcaaaaacacagacucgcguugcaaggcgaggcagcuugaguuaaacgaacguacuugcagaugugacaagccaaggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5430 - RNA, 977 nt, Artificial Sequence
  mRNA product Design3 comprising derived and/or modified sequence from Homo sapiens__NP_061986.1__HsFGF21(L126R,P199G,A208E) (opt1)
gggagagucccgcagucggcguccagcggcucugcuuguucgugugugugucguugcaggccuuauucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcgccugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggggcucccagggccggagccccuccuacgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5431 - RNA, 2534 nt, Artificial Sequence
  mRNA product Design3 comprising derived and/or modified sequence from Mus musculus__NP_001276387.1__MmHGF (opt1)
gggagagucccgcagucggcguccagcggcucugcuuguucgugugugugucguugcaggccuuauucaagcuuaccaugauguggggcaccaagcugcuccccgugcugcugcuccagcacguccugcugcaccuccugcugcuccacguggccaucccguacgccgaggggcagaagaagcgccggaacacccugcacgaguucaagaagagcgcgaagacgacccugaccaaggaggacccccuccugaagaucaagaccaagaaggugaacuccgccgacgagugcgccaaccgcugcauccggaaccgcggcuucacguucaccugcaaggccuucgucuucgacaagagccggaagcgcugcuacugguaccccuucaacuccaugagcuccggggugaagaagggcuucgggcacgaguucgaccuguacgagaacaaggacuacauccggaacugcaucaucggcaagggcgggagcuacaagggcaccguguccaucaccaagagcgggaucaagugccagcccuggaacuccaugaucccgcacgagcacagcuuccuccccuccagcuaccgcggcaaggaccugcaggagaacuacugccggaacccccgcggggaggagggcggccccuggugcuucacguccaacccggagguccgguacgaggugugcgacaucccccagugcagcgagguggagugcaugaccugcaacggggaguccuaccgcggccccauggaccacaccgagagcgggaagaccugccagcggugggaccagcagacgccccaccgccacaaguuccugccggagcgguaccccgacaagggcuucgacgacaacuacugccgcaaccccgacggcaagccccggccguggugcuacacccucgaccccgacacccccugggaguacugcgccaucaagaccugcgcgcacuccgccgucaacgagacggacgugcccauggagaccaccgagugcauccaggggcagggcgagggguaccgcggcaccagcaacacgaucuggaacgggaucccgugccagcggugggacucccaguacccccacaagcacgacaucacccccgagaacuucaagugcaaggaccugcgcgagaacuacugccggaaccccgacggcgccgagagcccguggugcuucaccaccgaccccaacauccgcgugggcuacugcagccagauccccaagugcgacgucuccagcgggcaggacugcuaccgcggcaacgggaagaacuacaugggcaaccuguccaagacgcggagcgggcucaccugcuccaugugggacaagaacauggaggaccugcaccgccacaucuucugggagcccgacgccagcaagcugaacaagaacuacugccggaacccggacgacgacgcgcacggccccuggugcuacaccggcaacccccucaucccgugggacuacugccccaucucccgcugcgagggggacaccacgcccaccaucgugaaccuggaccaccccgugaucagcugcgccaagaccaagcagcugcgggucgugaacggcaucccgacccagacgaccgugggguggauggucucccucaaguaccgcaacaagcacaucugcggcgggagccugaucaaggaguccugggugcugaccgcccggcagugcuuccccgcccgcaacaaggaccucaaggacuacgaggccuggcugggcauccacgacgugcacgagcggggcgaggagaagcgcaagcagauccugaacaucagccagcucgucuacgggcccgagggcuccgaccuggugcugcucaagcuggcgcggcccgccauccuggacaacuucgugagcaccaucgaccucccguccuacgggugcacgauccccgagaagaccaccugcagcaucuacggcuggggcuacaccgggcugaucaacgccgacggccugcuccgcgucgcccaccuguacaucauggggaacgagaagugcucccagcaccaccagggcaaggugacccugaacgagagcgagcucugcgccggggcggagaagaucggcuccggccccugcgagggggacuacggcgggccccugaucugcgagcagcacaagaugcggaugguccugggcgugaucgugccggggcgcggcugcgccauccccaaccggcccggcaucuucguccgcguggccuacuacgccaaguggauccacaaggugauccugacguacaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5432 - RNA, 995 nt, Artificial Sequence
  mRNA product Design3 comprising derived and/or modified sequence from Homo sapiens__NP_002119.1__HsHMGB1 (opt1)
gggagagucccgcagucggcguccagcggcucugcuuguucgugugugugucguugcaggccuuauucaagcuuaccaugggcaagggggaccccaagaagccgcgcggcaagaugagcagcuacgccuucuucgugcagaccugccgggaggagcacaagaagaagcaccccgacgccagcgucaacuucuccgaguucagcaagaagugcuccgagcgcuggaagaccaugagcgcgaaggagaaggggaaguucgaggacauggccaaggccgacaaggcccgguacgagcgcgagaugaagacguacaucccgcccaagggcgagaccaagaagaaguucaaggaccccaacgcccccaagcggccgcccuccgcguucuuccuguucugcagcgaguaccgccccaagaucaagggggagcaccccggccucuccaucggcgacguggccaagaagcugggggagauguggaacaacaccgccgccgacgacaagcagcccuacgagaagaaggcggccaagcugaaggagaaguacgagaaggacaucgccgccuaccgggccaagggcaagcccgacgcggccaagaaggggguggucaaggccgagaaguccaagaagaagaaggaggaggaggaggacgaggaggacgaggaggacgaggaggaggaggaggacgaggaggacgaggacgaggaggaggacgacgacgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5433 - RNA, 992 nt, Artificial Sequence
  mRNA product Design3 comprising derived and/or modified sequence from Mus musculus__NP_001273985.1__MmVEGFA (opt1)
gggagagucccgcagucggcguccagcggcucugcuuguucgugugugugucguugcaggccuuauucaagcuuaccaugaacuuccugcucagcugggugcacuggacccuggcccugcuccuguaccugcaccacgcgaaguggucgcaggccgccccgacgaccgagggcgagcagaagagccacgaggucaucaaguucauggacguguaccagcggagcuacugccgccccaucgagacccucguggacaucuuccaggaguacccggacgagaucgaguacaucuucaagccgucgugcgucccccugaugcggugcgcggggugcugcaacgacgaggcccuggagugcgugccgacgagcgagagcaacaucaccaugcagaucaugcggaucaagccgcaccagucgcagcacaucggcgagaugagcuuccuccagcacagccgcugcgagugccggcccaagaaggaccggaccaagccggagaagaagucggugcgcggcaaggggaagggccagaagcggaagcggaagaagagccgcuucaagagcuggucgguccacugcgagccgugcagcgagcggcggaagcaccuguucgugcaggacccccagacgugcaagugcagcugcaagaacaccgacucgcgcugcaaggcccggcagcuggagcucaacgagcggaccugccgcugcgacaagccgcggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5434 - RNA, 977 nt, Artificial Sequence
  mRNA product Design3 comprising derived and/or modified sequence from Homo sapiens__NP_061986.1__HsFGF21(L126R,P199G,A208E) (opt2)
gggagagucccgcagucggcguccagcggcucugcuuguucgugugugugucguugcaggccuuauucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcgccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggcggcucccagggccgcucccccuccuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5435 - RNA, 2534 nt, Artificial Sequence
  mRNA product Design3 comprising derived and/or modified sequence from Mus musculus__NP_001276387.1__MmHGF (opt2)
gggagagucccgcagucggcguccagcggcucugcuuguucgugugugugucguugcaggccuuauucaagcuuaccaugauguggggcaccaagcuccuccccguccuccuccuccagcacguccuccuccaccuccuccuccuccacgucgccauccccuacgccgagggccagaagaagcgccgcaacacccuccacgaguucaagaaguccgccaagaccacccucaccaaggaggacccccuccucaagaucaagaccaagaaggucaacuccgccgacgagugcgccaaccgcugcauccgcaaccgcggcuucaccuucaccugcaaggccuucgucuucgacaagucccgcaagcgcugcuacugguaccccuucaacuccauguccuccggcgucaagaagggcuucggccacgaguucgaccucuacgagaacaaggacuacauccgcaacugcaucaucggcaagggcggcuccuacaagggcaccgucuccaucaccaaguccggcaucaagugccagcccuggaacuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccccauggaccacaccgaguccggcaagaccugccagcgcugggaccagcagaccccccaccgccacaaguuccuccccgagcgcuaccccgacaagggcuucgacgacaacuacugccgcaaccccgacggcaagccccgccccuggugcuacacccucgaccccgacacccccugggaguacugcgccaucaagaccugcgcccacuccgccgucaacgagaccgacguccccauggagaccaccgagugcauccagggccagggcgagggcuaccgcggcaccuccaacaccaucuggaacggcauccccugccagcgcugggacucccaguacccccacaagcacgacaucacccccgagaacuucaagugcaaggaccuccgcgagaacuacugccgcaaccccgacggcgccgagucccccuggugcuucaccaccgaccccaacauccgcgucggcuacugcucccagauccccaagugcgacgucuccuccggccaggacugcuaccgcggcaacggcaagaacuacaugggcaaccucuccaagacccgcuccggccucaccugcuccaugugggacaagaacauggaggaccuccaccgccacaucuucugggagcccgacgccuccaagcucaacaagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccagaccaccgucggcuggauggucucccucaaguaccgcaacaagcacaucugcggcggcucccucaucaaggaguccuggguccucaccgcccgccagugcuuccccgcccgcaacaaggaccucaaggacuacgaggccuggcucggcauccacgacguccacgagcgcggcgaggagaagcgcaagcagauccucaacaucucccagcucgucuacggccccgagggcuccgaccucguccuccucaagcucgcccgccccgccauccucgacaacuucgucuccaccaucgaccuccccuccuacggcugcaccauccccgagaagaccaccugcuccaucuacggcuggggcuacaccggccucaucaacgccgacggccuccuccgcgucgcccaccucuacaucaugggcaacgagaagugcucccagcaccaccagggcaaggucacccucaacgaguccgagcucugcgccggcgccgagaagaucggcuccggccccugcgagggcgacuacggcggcccccucaucugcgagcagcacaagaugcgcaugguccucggcgucaucguccccggccgcggcugcgccauccccaaccgccccggcaucuucguccgcgucgccuacuacgccaaguggauccacaaggucauccucaccuacaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5436 - RNA, 995 nt, Artificial Sequence
  mRNA product Design3 comprising derived and/or modified sequence from Homo sapiens__NP_002119.1__HsHMGB1 (opt2)
gggagagucccgcagucggcguccagcggcucugcuuguucgugugugugucguugcaggccuuauucaagcuuaccaugggcaagggcgaccccaagaagccccgcggcaagauguccuccuacgccuucuucguccagaccugccgcgaggagcacaagaagaagcaccccgacgccuccgucaacuucuccgaguucuccaagaagugcuccgagcgcuggaagaccauguccgccaaggagaagggcaaguucgaggacauggccaaggccgacaaggcccgcuacgagcgcgagaugaagaccuacaucccccccaagggcgagaccaagaagaaguucaaggaccccaacgcccccaagcgcccccccuccgccuucuuccucuucugcuccgaguaccgccccaagaucaagggcgagcaccccggccucuccaucggcgacgucgccaagaagcucggcgagauguggaacaacaccgccgccgacgacaagcagcccuacgagaagaaggccgccaagcucaaggagaaguacgagaaggacaucgccgccuaccgcgccaagggcaagcccgacgccgccaagaagggcgucgucaaggccgagaaguccaagaagaagaaggaggaggaggaggacgaggaggacgaggaggacgaggaggaggaggaggacgaggaggacgaggacgaggaggaggacgacgacgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5437 - RNA, 992 nt, Artificial Sequence
  mRNA product Design3 comprising derived and/or modified sequence from Mus musculus__NP_001273985.1__MmVEGFA (opt2)
gggagagucccgcagucggcguccagcggcucugcuuguucgugugugugucguugcaggccuuauucaagcuuaccaugaacuuccuccucuccuggguccacuggacccucgcccuccuccucuaccuccaccacgccaaguggucccaggccgcccccaccaccgagggcgagcagaagucccacgaggucaucaaguucauggacgucuaccagcgcuccuacugccgccccaucgagacccucgucgacaucuuccaggaguaccccgacgagaucgaguacaucuucaagcccuccugcgucccccucaugcgcugcgccggcugcugcaacgacgaggcccucgagugcguccccaccuccgaguccaacaucaccaugcagaucaugcgcaucaagccccaccagucccagcacaucggcgagauguccuuccuccagcacucccgcugcgagugccgccccaagaaggaccgcaccaagcccgagaagaaguccguccgcggcaagggcaagggccagaagcgcaagcgcaagaagucccgcuucaaguccugguccguccacugcgagcccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5438 - RNA, 977 nt, Artificial Sequence
  mRNA product Design3 comprising derived and/or modified sequence from Homo sapiens__NP_061986.1__HsFGF21(L126R,P199G,A208E) (opt3)
gggagagucccgcagucggcguccagcggcucugcuuguucgugugugugucguugcaggccuuauucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugagagauuacuggaagauggguauaacgucuaccagagcgaggcacacggacuucccuugcaucugccugguaauaaaaguccacacagggaccccgccccucggggcccagcucgcuuucuaccgcuccccgggcugccuccagcccuucccgaaccuccaggcauucuggcgccccagccgccugaugugggauccucugaccccuugagcaugguuggugggucccagggaagaucaccaaguuaugagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5439 - RNA, 2534 nt, Artificial Sequence
  mRNA product Design3 comprising derived and/or modified sequence from Mus musculus__NP_001276387.1__MmHGF (opt3)
gggagagucccgcagucggcguccagcggcucugcuuguucgugugugugucguugcaggccuuauucaagcuuaccaugauguggggcaccaagcugcuccccgugcuucuguugcagcacgucuuacugcaucuacuccugcuucacguugccaucccuuacgcugaggggcaaaagaagagaaggaacacacugcaugaguucaaaaagagcgcaaaaacuacguugaccaaggaggacccacuccugaagauuaaaacaaagaaaguaaauuccgccgaugaaugcgcgaaccgguguauacgcaaucgaggauuuacuuuuaccugcaaggcuuucguguucgacaaaucucguaagagauguuauugguacccguuuaacucaaugaguagcggugugaagaaaggcuucgggcacgaguuugaucuguaugaaaauaaggacuacaucaggaacugcauuaucggaaaaggcgguuccuauaaggggacagucucuauuaccaaaucgggaaucaagugucagcccuggaacucaaugauaccucaugagcacagcuuccucccaaguuccuaccggggcaaagauuuacaggagaauuauugccgcaaucccagaggcgaagaagggggaccuugguguuuuacuucuaacccagaagugagguacgagguuugcgacaucccccaguguagcgagguggaaugcaugacauguaauggugaguccuaccggggcccuauggaucacaccgaaucagggaagacgugccaacgcugggaccagcagacuccacaucgacacaaguuccugccggagagauaucccgauaaaggauuugacgauaacuacugcaggaauccugacggcaagccacggcccugguguuauacccuugauccugacacaccaugggaauacugcgccauuaaaacuugugcacauagugccgucaacgagaccgacgugcccauggagacaaccgaaugcauccagggucaaggggagggauaucguggcacgagcaauacuauuuggaacggcaucccgugucagcgcugggauucucaguacccucacaagcacgacauaacacccgaaaacuucaaaugcaaggauuugagagagaauuauuguaggaacccagacggggcugaauccccuuggugcuuuaccacugaucccaauauucggguaggauacuguucacagaucccaaagugcgacguuagcaguggucaagauuguuaccgaggcaacgggaaaaauuauaugggaaaccugucuaagacacgcuccggccuaaccugcagcaugugggacaaaaauauggaggaucuccauagacacauuuucugggagcccgacgcaucgaagcugaacaaaaauuacugcaggaacccugaugacgacgcccaugguccaugguguuauacggggaauccgcuuauccccugggauuacugcccuaucucucggugugaaggcgacaccacaccaacuauugugaaccuggaucaccccgucauauccugcgcuaagaccaagcaguugcgcguggugaauggaaucccuacacagacuaccgucggcuggaugguuucacucaaauauagaaacaagcauauuugugggggaagucugaucaaagagagcuggguguuaacagccaggcaaugcuucccagcgcguaauaaggaccugaaagauuacgaagcauggcucgguauacacgacguacacgagcggggcgaagagaagcgaaagcagauucuuaacaucucccagcugguguaugggcccgagggaucugauuugguccuacugaaacucgccagaccggcuauccuggacaacuuugugagcaccauugaucuuccuucauacggcuguacuaucccagaaaagacgacaugcaguauuuacgguuggggguauaccggccugauaaaugccgacggauugcucaggguugcacaucuguacaucaugggcaacgagaaauguucccagcaccaucaagggaaggugacuuuaaaugaaagcgagcugugcgcuggagccgagaaaauugguucuggccccugugaaggggauuauggaggcccucuaaucugcgagcagcacaagaugcgcaugguccucggugugaucguacccgggcggggcugcgcgauuccaaacagaccuggaauauucguuaggguggccuacuaugcaaaauggauccacaaggucauucugaccuacaaacuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5440 - RNA, 995 nt, Artificial Sequence
  mRNA product Design3 comprising derived and/or modified sequence from Homo sapiens__NP_002119.1__HsHMGB1 (opt3)
gggagagucccgcagucggcguccagcggcucugcuuguucgugugugugucguugcaggccuuauucaagcuuaccaugggcaagggggaccccaaaaagccuagaggaaaaaugagcuccuacgccuucuuugugcagaccugcagggaggaacacaagaaaaagcauccagaugcuucugucaacuucucagaguuuaguaagaaauguagcgaacgguggaagacaauguccgcaaaagagaaggguaaauucgaagacauggccaaggcggauaaggcucgcuaugagcgagagaugaaaacuuacaucccgcccaagggcgaaacgaaaaagaaauuuaaggacccuaaugccccaaaacgucccccuucugcauucuuucuguucugcucggaguauagaccaaagauuaagggggaacaccccggacucucaauaggcgauguugccaagaaacuuggugagauguggaacaauaccgcugcagacgauaaacaaccuuacgagaagaaagccgcuaagcugaaggaaaaauaugagaaggacaucgccgcguacagggcaaaagggaagccagaugccgcuaaaaagggagugguaaaggccgagaaaagcaagaaaaagaaagaagaagaggaggacgaagaggaugaagaggacgaagaggaggaagaggaugaagaggacgaagacgaggaggaagaugacgaugacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5441 - RNA, 992 nt, Artificial Sequence
  mRNA product Design3 comprising derived and/or modified sequence from Mus musculus__NP_001273985.1__MmVEGFA (opt3)
gggagagucccgcagucggcguccagcggcucugcuuguucgugugugugucguugcaggccuuauucaagcuuaccaugaacuuccugcucagcugggugcacuggacccuugcccuguuguuauaccugcaucacgcuaaguggucccaggcagcccccacaacugagggcgaacaaaaaucucaugaggucaucaaguuuauggacguuuaucagagaucauacugcaggccuauugaaacgcuaguggauauauuccaggaguauccagacgaaaucgaguacauuuuuaaaccgaguuguguaccccucaugcggugcgcgggguguugcaaugaugaggcucuggaaugugugccuaccagcgaguccaacaucacaaugcagauuaugcgcaucaagccacaccaaucucagcauauaggagaaaugucguuccuucagcacucacgaugcgagugucgucccaaaaaggacagaacuaagccugagaaaaagagcgucagggguaaaggcaaggggcagaaacggaagcgcaagaaaaguagauuuaaguccuggucugugcacugcgaaccauguagcgagaggcggaaacaucuguucguucaagauccccagaccugcaaguguuccugcaaaaauacagacucacgcugcaaggcccgacaguuggaacucaacgagagaaccuguaggugcgauaaaccucggcguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5442 - RNA, 977 nt, Artificial Sequence
  mRNA product Design3 comprising derived and/or modified sequence from Homo sapiens__NP_061986.1__HsFGF21(L126R,P199G,A208E) (opt4)
gggagagucccgcagucggcguccagcggcucugcuuguucgugugugugucguugcaggccuuauucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagagacugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggcggcagccagggcagaagccccagcuacgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5443 - RNA, 2534 nt, Artificial Sequence
  mRNA product Design3 comprising derived and/or modified sequence from Mus musculus__NP_001276387.1__MmHGF (opt4)
gggagagucccgcagucggcguccagcggcucugcuuguucgugugugugucguugcaggccuuauucaagcuuaccaugauguggggcaccaagcugcugcccgugcugcugcugcagcacgugcugcugcaccugcugcugcugcacguggccauccccuacgccgagggccagaagaagagaagaaacacccugcacgaguucaagaagagcgccaagaccacccugaccaaggaggacccccugcugaagaucaagaccaagaaggugaacagcgccgacgagugcgccaacagaugcaucagaaacagaggcuucaccuucaccugcaaggccuucguguucgacaagagcagaaagagaugcuacugguaccccuucaacagcaugagcagcggcgugaagaagggcuucggccacgaguucgaccuguacgagaacaaggacuacaucagaaacugcaucaucggcaagggcggcagcuacaagggcaccgugagcaucaccaagagcggcaucaagugccagcccuggaacagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccccauggaccacaccgagagcggcaagaccugccagagaugggaccagcagaccccccacagacacaaguuccugcccgagagauaccccgacaagggcuucgacgacaacuacugcagaaaccccgacggcaagcccagacccuggugcuacacccuggaccccgacacccccugggaguacugcgccaucaagaccugcgcccacagcgccgugaacgagaccgacgugcccauggagaccaccgagugcauccagggccagggcgagggcuacagaggcaccagcaacaccaucuggaacggcauccccugccagagaugggacagccaguacccccacaagcacgacaucacccccgagaacuucaagugcaaggaccugagagagaacuacugcagaaaccccgacggcgccgagagccccuggugcuucaccaccgaccccaacaucagagugggcuacugcagccagauccccaagugcgacgugagcagcggccaggacugcuacagaggcaacggcaagaacuacaugggcaaccugagcaagaccagaagcggccugaccugcagcaugugggacaagaacauggaggaccugcacagacacaucuucugggagcccgacgccagcaagcugaacaagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccacccagaccaccgugggcuggauggugagccugaaguacagaaacaagcacaucugcggcggcagccugaucaaggagagcugggugcugaccgccagacagugcuuccccgccagaaacaaggaccugaaggacuacgaggccuggcugggcauccacgacgugcacgagagaggcgaggagaagagaaagcagauccugaacaucagccagcugguguacggccccgagggcagcgaccuggugcugcugaagcuggccagacccgccauccuggacaacuucgugagcaccaucgaccugcccagcuacggcugcaccauccccgagaagaccaccugcagcaucuacggcuggggcuacaccggccugaucaacgccgacggccugcugagaguggcccaccuguacaucaugggcaacgagaagugcagccagcaccaccagggcaaggugacccugaacgagagcgagcugugcgccggcgccgagaagaucggcagcggccccugcgagggcgacuacggcggcccccugaucugcgagcagcacaagaugagaauggugcugggcgugaucgugcccggcagaggcugcgccauccccaacagacccggcaucuucgugagaguggccuacuacgccaaguggauccacaaggugauccugaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5444 - RNA, 995 nt, Artificial Sequence
  mRNA product Design3 comprising derived and/or modified sequence from Homo sapiens__NP_002119.1__HsHMGB1 (opt4)
gggagagucccgcagucggcguccagcggcucugcuuguucgugugugugucguugcaggccuuauucaagcuuaccaugggcaagggcgaccccaagaagcccagaggcaagaugagcagcuacgccuucuucgugcagaccugcagagaggagcacaagaagaagcaccccgacgccagcgugaacuucagcgaguucagcaagaagugcagcgagagauggaagaccaugagcgccaaggagaagggcaaguucgaggacauggccaaggccgacaaggccagauacgagagagagaugaagaccuacaucccccccaagggcgagaccaagaagaaguucaaggaccccaacgcccccaagagaccccccagcgccuucuuccuguucugcagcgaguacagacccaagaucaagggcgagcaccccggccugagcaucggcgacguggccaagaagcugggcgagauguggaacaacaccgccgccgacgacaagcagcccuacgagaagaaggccgccaagcugaaggagaaguacgagaaggacaucgccgccuacagagccaagggcaagcccgacgccgccaagaagggcguggugaaggccgagaagagcaagaagaagaaggaggaggaggaggacgaggaggacgaggaggacgaggaggaggaggaggacgaggaggacgaggacgaggaggaggacgacgacgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5445 - RNA, 992 nt, Artificial Sequence
  mRNA product Design3 comprising derived and/or modified sequence from Mus musculus__NP_001273985.1__MmVEGFA (opt4)
gggagagucccgcagucggcguccagcggcucugcuuguucgugugugugucguugcaggccuuauucaagcuuaccaugaacuuccugcugagcugggugcacuggacccuggcccugcugcuguaccugcaccacgccaaguggagccaggccgcccccaccaccgagggcgagcagaagagccacgaggugaucaaguucauggacguguaccagagaagcuacugcagacccaucgagacccugguggacaucuuccaggaguaccccgacgagaucgaguacaucuucaagcccagcugcgugccccugaugagaugcgccggcugcugcaacgacgaggcccuggagugcgugcccaccagcgagagcaacaucaccaugcagaucaugagaaucaagccccaccagagccagcacaucggcgagaugagcuuccugcagcacagcagaugcgagugcagacccaagaaggacagaaccaagcccgagaagaagagcgugagaggcaagggcaagggccagaagagaaagagaaagaagagcagauucaagagcuggagcgugcacugcgagcccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5446 - RNA, 977 nt, Artificial Sequence
  mRNA product Design3 comprising derived and/or modified sequence from Homo sapiens__NP_061986.1__HsFGF21(L126R,P199G,A208E) (opt5)
gggagagucccgcagucggcguccagcggcucugcuuguucgugugugugucguugcaggccuuauucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagagacugcuugaagauggcuauaacguguaccaguccgaggcccacgggcugccccuccaucugccuggaaauaaaagcccgcaccgggaccccgcgccucgcggccccgccagauuucugccucuccccgggcugccgccugcccuucccgaaccucccggaauccuggcuccccagccuccggauguugggucuuccgacccccucagcauggugggcgggucucagggacgguccccuagcuaugagucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5447 - RNA, 2534 nt, Artificial Sequence
  mRNA product Design3 comprising derived and/or modified sequence from Mus musculus__NP_001276387.1__MmHGF (opt5)
gggagagucccgcagucggcguccagcggcucugcuuguucgugugugugucguugcaggccuuauucaagcuuaccaugauguggggcaccaagcugcuccccgugcugcuucugcagcacguccuccugcaucuucugcuccugcacguugccaucccuuacgcugaggggcagaaaaagagacggaacacacugcaugaguucaaaaagagcgccaaaacgacccucacaaaggaagacccgcugcuuaagauuaaaaccaagaaagucaauuccgcggaugaaugcgcuaaccgcuguaucagaaaucggggauuuacauuuaccugcaaggccuucguguucgacaaaucucgcaagagauguuauugguaccccuuuaacagcauguccucuggcgugaagaaaggguucggacacgaguuugaucuguaugaaaauaaggacuacauucggaacugcaucauuggcaaagggggaagcuauaagggcacaguguccaucaccaaaucuggcaucaagugucaaccuuggaauagcaugauuccccaugagcacuccuuccucccuagcucuuaccgcgggaaagaucugcaggagaacuauugcagaaauccccggggagaagagggcgggccuugguguuuuacguccaacccggaaguucgcuacgaggugugcgacaucccccaguguagcgaggucgaaugcaugaccuguaauggagagucuuacagaggcccuauggaucacacagaauccgggaagaccugccaacggugggaccagcagacaccccaucgccacaaguuccuuccugagagauaucccgauaaaggauuugacgauaacuacugccggaauccggacggcaagccucgccccugguguuauacccuggauccugacacgcccugggaauacugcgccauuaaaacaugugcucauagcgccgugaacgagaccgacguucccauggagacaaccgaaugcauccagggccaaggggagggauauagaggcaccucuaauacaauuuggaacgggaucccuugucagcggugggauucccaguacccgcacaagcacgacauuacgcccgaaaacuucaaaugcaaggaucucagagagaauuauugucgcaacccugacggagcugaaagccccuggugcuuuaccacagauccuaauauccgggugggcuacuguucccagauccccaagugcgacgucucuagcgggcaagauuguuacagaggaaacggcaaaaauuauaugggcaaccuguccaagacccgcagcgggcugacaugcucuaugugggacaaaaauauggaggaucuccaucggcacauuuucugggagccggacgccuccaagcugaacaaaaauuacugcagaaacccugaugacgacgcgcauggacccugguguuauaccggcaauccucuuauccccugggauuacugcccuauuagccgcugugaaggggacacgacacccaccaucgugaaccuggaucacccggugauuucuugcgccaagaccaagcagcuccgggucguuaauggaaucccuacacagaccacagugggcuggauggugagccugaaauauagaaacaagcauaucugugggggcucccuuauuaaagagucuuggguccugacggcucgccaaugcuuccccgcccggaauaaggaccucaaagauuacgaggcuuggcugggaauccacgacgugcacgaaagaggcgaagagaagcgcaagcagauucugaacaucagccagcucguuuaugggcccgagggauccgaucuggugcuucugaaacucgcccggccugcgauucuggacaacuuugucagcaccaucgaucuuccgucuuacggcuguacaauccccgaaaagaccacaugcuccauuuacggguggggauauaccggccugaucaaugccgacgggcuccugagaguggcucaucuguacauuaugggcaacgagaaauguagccagcaccaucaaggaaagguuacgcucaaugaaucugagcugugcgccggcgcugagaaaaucggguccggaccuugugaaggcgauuaugggggaccccuuauuugcgagcagcacaagaugcggauggugcugggcgucaucgugccugggcgcggcugcgccauucccaacagaccuggaaucuucguccggguggccuacuaugcuaaauggauccacaagguuauucucaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5448 - RNA, 995 nt, Artificial Sequence
  mRNA product Design3 comprising derived and/or modified sequence from Homo sapiens__NP_002119.1__HsHMGB1 (opt5)
gggagagucccgcagucggcguccagcggcucugcuuguucgugugugugucguugcaggccuuauucaagcuuaccaugggcaagggggaccccaaaaagccuagaggaaaaaugagcuccuacgccuucuuugugcagaccugccgggaggaacacaagaaaaagcauccggaugcuucugucaacuucagcgaguuuuccaagaaauguucugaacgcuggaagacaaugagcgccaaagagaagggcaaauucgaagacauggcgaaggcugauaaggccagauaugagcgggagaugaaaacguacauucccccuaagggggaaaccaaaaagaaauuuaaggaccccaaugccccuaaaagacccccuuccgcuuucuuucuguucugcucugaguaucgcccgaagaucaagggagaacaccccggccucagcaucggggauguugccaaaaagcugggagagauguggaacaauacagcugccgacgauaaacaaccuuacgagaagaaagcggccaaacuuaaggaaaaguaugagaaggacauugcugccuaccgggcuaaaggcaagcccgaugccgcgaaaaagggcguggugaaggccgaaaaauccaagaaaaagaaagaggaagaggaggacgaagaggaugaagaggacgaagaggaggaagaggaugaagaggacgaagacgaggaggaagaugacgaugacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5449 - RNA, 992 nt, Artificial Sequence
  mRNA product Design3 comprising derived and/or modified sequence from Mus musculus__NP_001273985.1__MmVEGFA (opt5)
gggagagucccgcagucggcguccagcggcucugcuuguucgugugugugucguugcaggccuuauucaagcuuaccaugaacuuccugcucagcugggugcacuggacccuggcccuucugcucuaccugcaucacgcuaaguggucccaggccgcgcccacaacggagggcgaacaaaaaucucaugaggucaucaaguuuauggacguuuaucagagaagcuacugccggccuauugaaacccuuguggauaucuuccaggaguauccggacgaaauugaguacaucuuuaaacccuccugugugccucugaugcgcugcgcuggguguugcaaugaugaggcccucgaauguguccccacaucugagagcaacauuaccaugcagaucaugagaaucaagccucaccaaucccagcauauuggagaaaugucuuuccugcagcacagccggugcgagugucgccccaaaaaggacagaacaaagccugagaaaaaguccgugcggggcaaagggaagggacagaaacgcaagagaaagaaaagccgguuuaagucuugguccguucacugcgaaccguguagcgagcgcagaaaacaucuguucgugcaagauccccagaccugcaaguguucuugcaaaaauacagacucccggugcaaggcccgccagcucgaacugaacgagagaaccugucggugcgauaaaccucgcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5450 - RNA, 977 nt, Artificial Sequence
  mRNA product Design3 comprising derived and/or modified sequence from Homo sapiens__NP_061986.1__HsFGF21(L126R,P199G,A208E) (opt6)
gggagagucccgcagucggcguccagcggcucugcuuguucgugugugugucguugcaggccuuauucaagcuuaccauggauucagaugaaacaggauuugaacacucaggauuaugggucucaguuuuagcaggacuauuacuaggagcaugucaagcacauccaauaccagacucaagcccauuauuacaauuuggaggacaaguaagacaaagauauuuauauacagaugacgcacaacaaacagaagcacauuuagaaauaagagaagacggcacaguaggaggagcagcagaucaaucaccagaaucacuauuacaauuaaaagcauuaaaaccaggaguaauacaaauauuaggaguaaaaacaucaagauucuuaugccaaagaccugacggagcauuauaugguucacuacacuuugacccagaagcauguucauucagagaaagacuacuagaagacggauauaauguuuaccaaucugaagcacauggauuaccacuacacuuaccaggaaauaaaucaccacaccgagacccagcaccacgaggaccagcaagauuccuaccacuaccaggauuaccaccagcauuaccagaaccaccaggaauacuagcuccacaaccaccagacguaggauccucagauccauuaucaaugguaggaggaucucaagguagaagucccucauacgaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5451 - RNA, 2534 nt, Artificial Sequence
  mRNA product Design3 comprising derived and/or modified sequence from Mus musculus__NP_001276387.1__MmHGF (opt6)
gggagagucccgcagucggcguccagcggcucugcuuguucgugugugugucguugcaggccuuauucaagcuuaccaugauguggggaacaaaacuauuaccaguauuauuauuacaacaugucuuauuacauuuacuucuacuacauguugcaauacccuaugccgaaggacaaaagaaaagaagaaacacucuucacgaguucaagaaaagcgcaaaaacaacauuaacaaaagaagacccacuacuaaaaauaaaaacaaagaaaguaaacucagcagaugaaugugccaacagauguauuagaaaccgggguuuuacuuuuacaugcaaagccuucguauucgauaaaucaaggaaaagaugcuacugguauccauucaauucaaugucauccggagucaagaaaggauucggccaugaauuugaccuauacgaaaauaaagauuauaucagaaacuguauaauaggaaaaggugguucauacaaaggaacaguaucaauaacaaaaagcgguauuaaaugucaacccuggaacucuaugauuccucaugaacauucauuuuuaccaucaucauacagagguaaagacuuacaagaaaauuacugcagaaauccaaggggagaagaaggcggaccauggugcuuuacaucaaaucccgaaguaagauaugaaguaugcgacauaccacaauguagugaaguugaauguaugacauguaauggagaaagcuacagagguccaauggaucauacagaaucaggaaaaacaugccaaagaugggaucaacaaacaccgcauagacauaaauuuuuaccagaaagauauccagauaaaggauucgaugacaauuacuguaggaaucccgacggaaaaccacgaccauggugcuauacacuagacccugauacuccaugggaauauugcgcuauaaaaacuugugcacauucagcaguaaacgaaaccgacguaccaauggaaaccacugaauguauacaagggcaaggagaaggauacagaggaacaucaaauacaauauggaacggaauacccugucaaagaugggauagccaauauccacauaaacacgacauaaccccagaaaacuuuaaauguaaagaucuaagagaaaauuacugcagaaaucccgauggcgcagaaucaccauggugcuucacaacagaucccaacauaagagucggauauugcucccagauuccuaaaugugauguaagcuccgggcaagacugcuaccgaggcaacgguaaaaauuacaugggaaacuuaaguaaaacaagaucaggauuaacaugcaguaugugggauaaaaauauggaggacuuacauagacauauauucugggaaccagaugcaucaaaacuuaacaaaaauuauugcagaaacccagacgacgaugcacacggaccaugguguuauacaggaaauccacuuauaccaugggacuauuguccaauaucacgaugcgaaggagauacaacaccaacaauaguaaacuuagaucauccaguaauaaguugcgcaaaaacuaaacaauuacgaguuguuaacggaauaccaacacaaacuacagucggauggaugguuucauuaaaauauagaaacaaacacauaugcggaggaucccuuauaaaagaauccuggguauuaacagcaagacaauguuuuccagccagaaauaaagaucucaaagacuacgaagcaugguuaggcauacacgauguacaugaacgaggagaagaaaaacgaaaacaaauauuaaauauaagccagcuaguuuauggaccagaaggaucggacuuaguacuauuaaaacuugcaagaccagcaauccuagacaauuuugucucaacaaucgacuuacccucauauggaugcacuauuccggagaaaacaacaugcuccauauacggauggggauauacaggauugauaaaugcagauggauuacuaagaguagcacaucuauacauaaugggaaaugaaaaauguucacaacaccaucaaggaaaaguaacacuaaacgaaagcgaauuaugugcaggcgcagagaaaauaggcaguggaccaugugaaggagauuacgguggaccacuaauaugcgaacaacauaaaaugagaaugguccuaggaguaauaguccccggaagaggaugugcaauaccaaaucgaccgggcauauuuguaagaguagcauacuacgcaaaauggauacacaaaguaauacuaacauacaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5452 - RNA, 995 nt, Artificial Sequence
  mRNA product Design3 comprising derived and/or modified sequence from Homo sapiens__NP_002119.1__HsHMGB1 (opt6)
gggagagucccgcagucggcguccagcggcucugcuuguucgugugugugucguugcaggccuuauucaagcuuaccaugggaaaaggagacccaaaaaaaccaagaggaaaaaugucaagcuacgcauucuucguacaaacaugcagagaagaacacaaaaaaaaacacccagacgcaagcguaaacuucagcgaauucagcaaaaaauguucagaaagauggaaaacaaugagcgcaaaagaaaaaggaaaauucgaagacauggcaaaagcagacaaagcaagauacgaaagagaaaugaaaacauacauaccaccaaaaggagaaacaaaaaaaaaauucaaagacccaaacgcgccaaaaagaccaccaucagcauucuucuuauucugcagugaauacagaccaaaaauaaaaggagaacacccaggacuaaguauaggagacguagcaaaaaaacuaggagaaauguggaacaacacagcagcagacgacaaacaaccauacgaaaaaaaagcagcaaaacuaaaagaaaaauacgaaaaagacauagcggcauacagagcaaaaggaaaaccagacgcagcaaaaaaaggaguaguaaaagcagaaaaaaguaaaaaaaaaaaagaagaagaagaagacgaagaagacgaagaagacgaagaagaagaagaagacgaagaagacgaagacgaagaagaagacgacgacgacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5453 - RNA, 992 nt, Artificial Sequence
  mRNA product Design3 comprising derived and/or modified sequence from Mus musculus__NP_001273985.1__MmVEGFA (opt6)
gggagagucccgcagucggcguccagcggcucugcuuguucgugugugugucguugcaggccuuauucaagcuuaccaugaacuuccuauuaagcuggguacacuggacacuagcacuacuacuauacuuacaccacgccaaauggagccaagcagcaccaacaacagaaggagaacaaaaaucacacgaaguaauaaaauucauggacguauaccaaagaucauacuguagaccaauagaaacacuaguagacauauuccaagaauacccagacgaaauagaauacauauucaaaccaucaugcguaccacuaaugagaugcgcaggaugcugcaacgacgaagcacuagaaugcguaccaacaucagaaucaaacauaacaaugcaaauaaugagaauaaaaccacaccaaagucaacacauaggagaaaugaguuuccuacaacacucaagaugcgaaugcagaccaaaaaaagacagaacaaaaccagaaaaaaaaucaguaagaggaaaaggaaaaggccaaaaaagaaaaagaaaaaaaucaagauucaaaagcuggucaguacacugugaaccauguucagaaagaagaaaacaccuauucguacaagacccacaaacaugcaaaugcaguugcaaaaacacagacucaagaugcaaagcaagacaacuagaauuaaaugaacgaacaugcagaugcgacaaaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5454 - RNA, 977 nt, Artificial Sequence
  mRNA product Design3 comprising derived and/or modified sequence from Homo sapiens__NP_061986.1__HsFGF21(L126R,P199G,A208E) (opt7)
gggagagucccgcagucggcguccagcggcucugcuuguucgugugugugucguugcaggccuuauucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagaggcugcuggaagauggguauaacguguaccagagugaggcccacggcuugccccuccaucugccagguaauaaaagcccgcaccgggaccccgcaccacgcgggcccgccagguuucugccacuccccggccugccgcccgccuugccagaacccccaggcauccuggcaccccagccaccggaugugggguccagcgacccccucaguauggucgguggcucccaggggcggagcccauccuaugagaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5455 - RNA, 2534 nt, Artificial Sequence
  mRNA product Design3 comprising derived and/or modified sequence from Mus musculus__NP_001276387.1__MmHGF (opt7)
gggagagucccgcagucggcguccagcggcucugcuuguucgugugugugucguugcaggccuuauucaagcuuaccaugauguggggcaccaagcugcuccccgugcuguugcugcagcacguccuccugcauuugcugcuccugcacguggccaucccauacgcagaggggcagaaaaagaggcggaacacucugcaugaguucaaaaagagcgccaaaaccacgcucacuaaggaggacccgcuguugaagauuaaaaccaagaaaguaaauuccgcggaugaaugcgccaaccgcuguaucaggaaucgggguuuuaccuucacuugcaaggcauuuguguucgacaaaagucgcaagagguguuauugguaccccuuuaacagcauguccaguggcgucaaaaagggguucggccacgaguuugaucuguaugaaaauaaggacuacauucggaacugcaucauugguaaagggggcagcuauaagggcaccguguccaucacgaaaagcgggaucaagugucaaccauggaacuccaugauuccccaugagcacaguuuccucccaagcuccuaccgcgguaaagaucugcaggagaauuauugcaggaauccccggggcgaagaagggggcccaugguguuuuacuagcaacccggaagugcgcuacgaggucugcgacaucccccaguguagugagguggaaugcaugaccugcaauggugaguccuacagggggccaauggaucacacugaaagcggcaagaccugucaacggugggaccagcagacuccccaucgccacaaguuccugccagagagguaucccgauaaaggcuuugacgauaacuacugccggaauccggacgggaagccccgcccaugguguuauacguuggaucccgacacuccaugggaauacugcgccauuaaaaccugugcacauuccgccguaaacgagacugacgugcccauggagaccaccgaaugcauccagggucaaggcgagggguauaggggcaccaguaauacgauuuggaacgguaucccaugucagcggugggauagccaguacccgcacaagcacgacauuacccccgaaaacuucaaaugcaaggaucuccgcgagaauuauuguaggaacccagacggcgcggaaucccccuggugcuucacuaccgauccaaauauccgggucggguacugcagccagauccccaagugugacgugaguuccggccaagauugcuacagggggaacgguaaaaauuauaugggcaaccugagcaagacccgcagugggcugacuuguuccaugugggacaaaaauauggaggaucuccaucggcacaucuuuugggagccggacgccagcaagcugaacaaaaauuacugcaggaacccagaugacgacgcacauggccccugguguuauacggguaaucccuugauuccaugggauuacugccccauuagccgcugugaaggcgacaccacuccaaccaucgugaaccuggaucacccggucauuuccugcgccaagaccaagcagcuccgggugguaaaugggauccccacucagacgaccgugggcuggauggucagucugaaauauaggaacaagcauaucugugggggcagccugauuaaagaguccuggguguugacugcccgccaaugcuucccagcacggaauaaggaccucaaagauuacgaagccuggcuggguauccacgacgugcacgagaggggcgaagagaagcggaaacagauucugaacaucagccagcucgucuaugggcccgaggguagugaucugguguugcugaagcucgcgcgcccagccauucuggacaacuuuguauccaccaucgaucugcccagcuacggcuguacuaucccggaaaagaccacgugcuccauuuacggguggggcuauaccggguugaucaaugcagacggccuccugaggguggcccaucuguacauuauggguaacgagaaaugcagucagcaccaucaagggaaggucacucucaaugaaagcgagcugugugcaggcgccgagaaaaucggcuccgggccaugcgaaggugauuauggcgggcccuugauuugugagcagcacaagaugcggauggugcugggcgucaucgugccaggucgcgggugcgccauucccaacaggccgggcaucuucgugcggguagcguacuaugcaaaauggauccacaaggugauucucaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5456 - RNA, 995 nt, Artificial Sequence
  mRNA product Design3 comprising derived and/or modified sequence from Homo sapiens__NP_002119.1__HsHMGB1 (opt7)
gggagagucccgcagucggcguccagcggcucugcuuguucgugugugugucguugcaggccuuauucaagcuuaccaugggcaagggggaccccaaaaagccaagggguaaaaugagcuccuacgccuucuuugugcagaccugccgggaggaacacaagaaaaagcauccggaugcaagugucaacuucagcgaguuuuccaagaaauguagugaacgcuggaagacuaugagcgccaaagagaagggcaaauucgaagacauggcgaaggccgauaaagcaagguaugagcgggagaugaagaccuacauucccccaaagggggaaacgaaaaagaaauuuaaggaccccaaugccccaaaaaggcccccauccgcauucuuucuguucugcagcgaguaucgcccgaagaucaagggcgaacaccccggucucuccaucggggauguggccaaaaagcugggcgagauguggaacaauacugcggccgacgauaaacaaccauacgagaagaaagcagccaaguugaaggaaaaauaugagaaggacauugccgcauaccgggccaaaggcaagcccgaugcggccaaaaaggggguagugaaggcagagaaaaguaagaaaaagaaagaagaagaggaggacgaagaggaugaagaggacgaagaggaggaagaggaugaagaggacgaagacgaggaggaagaugacgaugacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5457 - RNA, 992 nt, Artificial Sequence
  mRNA product Design3 comprising derived and/or modified sequence from Mus musculus__NP_001273985.1__MmVEGFA (opt7)
gggagagucccgcagucggcguccagcggcucugcuuguucgugugugugucguugcaggccuuauucaagcuuaccaugaacuuccugcucagcugggugcacuggacccuggccuugcugcucuaccugcaucacgcaaaguggucccaggccgcgcccacuaccgagggcgaacagaaaagucaugaggucaucaaguuuauggacguguaucaaaggagcuacugccggccaauugaaacguugguagauaucuuccaggaguauccggacgaaauugaguacaucuuuaaacccuccugugugccacugaugcgcugcgccggguguugcaaugaugaggcacucgaauguguccccaccagugagagcaacauuacuaugcagaucaugaggaucaagccacaccaaucccagcauauuggugaaaugagcuuccugcagcacucccggugcgagugucgccccaaaaaggacaggaccaagccagagaaaaagagugugcggggcaaagggaagggccagaaacgcaagaggaaaaagagccgguuuaaguccuggagcgugcacugcgaaccguguagugagcgcaggaaacaucuguucguccaagauccccagacuugcaagugcuccuguaaaaauaccgacagccggugcaaggcccgccagcucgaacugaacgagaggacgugucggugcgauaaaccaaggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5458 - RNA, 977 nt, Artificial Sequence
  mRNA product Design3 comprising derived and/or modified sequence from Homo sapiens__NP_061986.1__HsFGF21(L126R,P199G,A208E) (opt8)
gggagagucccgcagucggcguccagcggcucugcuuguucgugugugugucguugcaggccuuauucaagcuuaccauggacucugacgaaaccggcuucgaacacuccggacucugggucuccguccucgccggccuccuccuaggcgccugccaagcccaccccauccccgacucauccccacuccuacaauucggcggccaaguccgucaacgcuaccucuauaccgaugacgcccaacaaaccgaagcccaccucgaaauccgcgaagacggaaccgucggcggcgccgcugaccaaucacccgaaucccuccuccaacucaaagcacucaaacccggcguaauccaaauccucggcguaaaaaccucacgauuucuaugucaaagacccgacggagcccuauacggcucucuacacuucgacccagaagcaugcuccuuccgcgaacgacuccucgaagacggauacaacgucuaccaaucagaagcccacggccuaccccuccaccuccccggcaacaaaucuccccaccgcgaccccgcaccccgcggccccgcccgcuuccucccccuccccggccuacccccagcccuacccgaaccacccggcauacucgcaccccaaccacccgacgucggcuccuccgacccccuauccauggucggcggcucccaaggccgcucccccucauacgaaucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5459 - RNA, 2340 nt, Artificial Sequence
  mRNA product Design3 comprising derived and/or modified sequence from Mus musculus__NP_001276387.1__MmHGF (opt8)
gggagagucccgcagucggcguccagcggcucugcuuguucgugugugugucguugcaggccuuauucaagcuuaccaugauguggggcacgaaacugcucccaguauugcucuugcaacacguccuacuccaccuucuacugcuacacgucgcuauacccuaugccgaaggacaaaagaaacgucgcaacacccuacacgaauuuaagaaaagcgccaagaccacacucacuaaagaagauccccuacucaaaauaaagaccaaaaaggugaacucggcugacgaaugcgccaaccgaugcauccgaaacagaggcuucacuuuuaccugcaaagccuucguuuucgacaagagccgaaaacgaugcuacugguacccauucaacagcauguccuccgggguaaagaaaggcuucggacaugaguucgaucuauacgaaaauaaagacuacauaagaaacugcauaaucggcaaaggaggguccuacaaaggcacagucagcaucacaaagucagggaucaaaugccaacccuggaacuccaugauaccacacgagcacaguuuccucccuaguagcuaccgaggaaaagaccuccaggagaacuacugccgcaacccccgcggggaagaaggcggaccuuggugcuucacaagcaaccccgagguccgcuacgaggucugcgacaucccccaaugcagcgaagucgagugcaugaccuguaacggagaaucauaccgaggcccaauggaucacaccgaauccggaaaaacaugccaacgaugggaccaacaaacaccgcaccgacacaaguuccuccccgaacgguaccccgacaaaggauucgacgacaacuacugccgcaaccccgacggaaaaccacgaccauggugcuacacgcucgacccggacacccccugggaauacugcgccaucaaaaccugcgcacacucagcggugaacgaaaccgauguaccaauggaaacaaccgaaugcauccaaggacaaggagagggcuacaggggcacgucaaauaccaucuggaacggcauaccaugccagcgcugggacagucaguacccccacaaacacgacauaacccccgaaaacuucaaaugcaaagaccucagagaaaacuacugccgcaaccccgacggcgccgaaucccccugguguuucacaaccgacccaaacauccgcgugggcuacugcucacaaauccccaagugcgacguaucaagcggccaagacugcuaucgcgggaacggcaaaaacuacaugggaaaccucucaaagaccagaagcggccuaacaugcucaaugugggacaaaaacauggaggaccuccaccggcacaucuuuugggaacccgacgcuuccaaacucaacaaaaacuacugccgaaaccccgacgacgaugcacacggcccauggugcuacacaggcaacccccugauacccugggacuacugccccaucuccagaugcgagggcgacacaacaccgaccaucguaaaucucgaccaccccguaaucuccugcgccaaaacaaaacaacuaagggucgugaacggaauccccacccaaacaacagugggcuggauggucagccucaaauacagaaacaagcacaucugcggcggcucccucaucaaggaaagcuggguacuaacagccaggcaaugcuuccccgccagaaauaaagaucuaaaagacuacgaagccuggcuaggcauccaugacguccacgaacgcggcgaggagaaacgaaaacaaauucucaacaucucucaacucgucuauggaccagaagggagcgaccucguucuucugaaacucgcccggcccgcaaucuuagacaacuucgucagcacaaucgaccuccccucauacggaugcaccaucccagaaaagacaaccugcagcauauacggauggggcuacaccggccugaucaacgcagacggccuucucagagucgcccaucucuacaucaugggaaacgaaaaaugcagccaacaccaccaaggcaaaguaacgcucaacgaauccgaacucugcgccggagcagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5460 - RNA, 995 nt, Artificial Sequence
  mRNA product Design3 comprising derived and/or modified sequence from Homo sapiens__NP_002119.1__HsHMGB1 (opt8)
gggagagucccgcagucggcguccagcggcucugcuuguucgugugugugucguugcaggccuuauucaagcuuaccauggggaaaggggacccgaaaaagccaagaggaaagaugucgagcuaugccuuuuucgugcaaacgugcagggaagaacacaagaaaaagcacccggacgcgagcgugaacuuuagcgaguucucgaaaaagugcucagaaagguggaagaccaugagcgcgaaagaaaaagggaaauuugaagauauggcaaaagcggacaaggcaagguacgagcgagaaaugaagacauauaucccgccaaagggcgagacaaagaagaaauucaaagacccgaacgcgcccaagcgcccgccaucggccuuuuuccuauucugcagcgaguacaggcccaagauaaagggcgagcacccaggauugagcauaggcgaugucgcgaaaaagcuaggggaaauguggaacaacacggccgcggacgauaaacagccguaugaaaagaaagcggccaagcucaaggaaaaguacgagaaagauaucgcggccuauagagcgaaaggaaaaccggacgcggccaagaaagggguagugaaagcggaaaagagcaagaaaaagaaagaggaagaggaagaugaagaggacgaggaagacgaagaggaagaggaagaugaagaggacgaggacgaggaagaggacgaugacgaugaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5461 - RNA, 992 nt, Artificial Sequence
  mRNA product Design3 comprising derived and/or modified sequence from Mus musculus__NP_001273985.1__MmVEGFA (opt8)
gggagagucccgcagucggcguccagcggcucugcuuguucgugugugugucguugcaggccuuauucaagcuuaccaugaacuuccuccucuccuggguccacuggacccucgcccuccuccucuaccuucaccacgcaaaauggucccaagccgcccccaccaccgaaggagaacaaaaaucccacgaagucauaaaauucauggacguauaccaacgaucauacugccgacccaucgaaacccuagucgacaucuuccaagaauacccagacgaaaucgaauacauauucaaacccuccugcguaccccucaugcgcugcgccggcugcugcaacgacgaagcccuagaaugcgucccaacaucagaaucaaacaucaccaugcaaaucaugcgcaucaaaccacaccaaucccaacacauaggcgaaauguccuuccuccaacacucacgcugcgaaugccgccccaaaaaagaccgaaccaaacccgaaaaaaaaucaguccgaggcaaaggaaaaggccaaaaacgcaagcgcaaaaaaucccgcuucaaauccugguccguccacugcgaacccugcuccgaacgccgaaaacaccucuucguccaagacccacaaaccugcaaaugcuccugcaaaaacaccgacuccagaugcaaagcacgccaacucgaacucaacgaaagaaccugccgcugcgacaaaccccgccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5462 - RNA, 977 nt, Artificial Sequence
  mRNA product Design3 comprising derived and/or modified sequence from Homo sapiens__NP_061986.1__HsFGF21(L126R,P199G,A208E) (opt9)
gggagagucccgcagucggcguccagcggcucugcuuguucgugugugugucguugcaggccuuauucaagcuuaccauggacuccgacgaaaccggauucgaacacucaggccucugggucucaguccucgccggccuccuccucggagccugccaagcccacccaauccccgacuccucaccacuccuccaauucggcggccaaguccgacaacgauaccucuacaccgacgacgcccaacaaaccgaagcccaccucgaaauccgcgaagacggcacaguaggaggcgccgccgaccaaucacccgaaucccuacuccaacuaaaagcacucaaacccggcgucauccaaauacucggcgucaaaaccucaagauuccucugccaacgccccgacggcgcccucuacggcucccuccacuucgaccccgaagccugcuccuuccgcgaacgccuccucgaagacggcuacaacgucuaccaauccgaagcccacggccucccccuccaccucccaggcaacaaauccccacaccgcgaccccgcaccccgcggcccagcccgcuuccucccccuccccggacuacccccugcccuacccgaaccaccaggcauccucgcaccccaaccacccgacgucggcuccuccgacccccucucaaugguaggcggcucacaaggccgaucccccuccuacgaauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5463 - RNA, 2534 nt, Artificial Sequence
  mRNA product Design3 comprising derived and/or modified sequence from Mus musculus__NP_001276387.1__MmHGF (opt9)
gggagagucccgcagucggcguccagcggcucugcuuguucgugugugugucguugcaggccuuauucaagcuuaccaugauguggggcacaaaacuccuuccgguacugcugcuacaacacgugcuucuccaccuccuucuacuccacgucgcaauccccuaugcagaagggcagaaaaagcgacgcaacacacuccacgaguucaagaaaucggccaaaacaacccuaaccaaagaggacccccuccucaaaaucaaaaccaagaaaguaaacuccgccgacgagugcgccaacagaugcauccgcaaccggggcuucaccuucacaugcaaagccuucguguucgauaaaagccgcaaacgaugcuacugguacccauucaacuccaugagcucgggaguuaagaaaggcuuuggccacgaauuugaccuauacgagaauaaagacuacauaagaaacugcaucaucgguaaaggcggcucauacaaagggaccguauccaucacaaaaagcggaauaaaaugccaaccguggaacucuaugauaccccacgaacacucauuccuaccauccucauaccgcggcaaagaccuacaagagaacuacugccgaaacccccgaggagaagaagggggaccauggugcuucaccucaaacccagagguacgguacgaagucugcgacaucccacaaugcagcgaaguagagugcaugaccuguaacggagaguccuaccggggaccaauggaccauaccgaaucgggaaaaacuugccaacgaugggaucaacaaacaccccaucgucacaaauuccuaccggaacgauacccagacaaaggauucgacgacaacuacugcagaaaucccgacgguaaacccagaccuuggugcuacacccuagaccccgacaccccaugggaauacugcgccauaaagaccugcgcacacucugccgucaacgagaccgacguccccauggaaacaaccgaaugcauacaggggcagggagagggcuaccgcggcaccagcaacaccaucuggaacgguauacccugccagcgaugggacagccaauacccccacaagcacgacauaaccccugagaacuucaagugcaaagaccuacgcgaaaacuacugccgaaacccagacggcgccgaaucaccaugguguuucacaacagacccaaacauccgcgucggcuacugcucccaaauacccaaaugcgacgucaguuccggacaagacugcuaccgaggcaacggaaagaacuacaugggaaaccucuccaaaacccguagcgguuuaacaugcuccaugugggacaagaacauggaagaccuacacagacauauauucugggaacccgacgcaagcaaacucaacaaaaauuacugccgcaaccccgacgacgaugcccauggccccuggugcuacaccggcaacccccugauccccugggacuacuguccaauaagccgaugcgagggggacaccaccccuaccaucgucaaccuggaccaccccgucaucuccugcgcaaaaaccaaacagcuccgaguagugaacggcaucccaacccagacaacggucggauggauggucucacuaaaauaccgaaacaaacacauaugcgguggaucccucaucaaagaaagcugggucuuaaccgcccgccaaugcuuccccgcacgaaacaaagaccuaaaagacuacgaagcauggcuaggcauccacgacguacacgaacgaggcgaagaaaaacgaaagcaaauccucaacaucucacaguuagucuacggaccagaagguucagaccucgugcuccuaaaguuagcccgccccgccauacuagacaacuucgucagcaccaucgaccuaccaucauacggaugcaccauaccagagaaaaccacaugcaguaucuacggcuggggcuacacgggccucaucaacgccgacggccuccuacgcguagcccaccucuauaucaugggcaacgaaaaaugcucacaacaccaccaagggaaaguaacacugaacgaauccgagcucugcgccggcgccgagaaaaucggauccggccccugcgaaggagacuacgggggaccacuaauaugcgaacagcacaagaugcgaaugguccucggagucaucguacccggccgaggcugcgcaauacccaaucgccccggcauauucguucgcguagccuacuacgcuaaauggauccacaaagucauacucaccuacaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5464 - RNA, 995 nt, Artificial Sequence
  mRNA product Design3 comprising derived and/or modified sequence from Homo sapiens__NP_002119.1__HsHMGB1 (opt9)
gggagagucccgcagucggcguccagcggcucugcuuguucgugugugugucguugcaggccuuauucaagcuuaccauggggaaaggggacccgaagaaaccaaggggaaaaaugucgagcuaugccuucuucgugcaaacgugcagggaggaacacaagaaaaagcacccagacgcgagcgugaacuuuagcgaguucucgaaaaagugcucggaaagguggaagacaaugagcgcgaaagagaaagggaaauuugaagauauggcgaaagcggacaaggccagguacgagcgagagaugaagaccuauaucccgcccaagggcgagacaaagaagaaauucaaagacccgaacgcgccaaagcgcccgcccucggcauuuuucuuguucuguagcgaguacaggccaaagaucaagggcgagcacccaggcuugagcauaggcgaugucgccaaaaagcucggggaaauguggaauaacacagcagcagacgauaaacagcccuaugaaaagaaagcggcaaagcucaaggaaaaguacgagaaagauaucgcggccuaucgcgcgaaagggaaaccggacgcggcaaagaaaggggucgugaaagcggaaaagagcaagaaaaagaaagaggaagaggaagaugaagaggacgaggaagaugaagaggaagaggaagaugaagaggacgaggacgaagaagaggacgaugacgaugaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5465 - RNA, 992 nt, Artificial Sequence
  mRNA product Design3 comprising derived and/or modified sequence from Mus musculus__NP_001273985.1__MmVEGFA (opt9)
gggagagucccgcagucggcguccagcggcucugcuuguucgugugugugucguugcaggccuuauucaagcuuaccaugaacuuccuccucuccuggguccacuggacacucgcccuccuccuauaccuacaccacgccaaauggagccaagccgcccccacaaccgaaggcgaacaaaaaucccacgaagucaucaaauucauggacgucuaccaacgcuccuacugccgccccaucgaaacccucgucgacaucuuccaagaauaccccgacgaaaucgaauacaucuucaaacccuccugcgucccccucaugcgcugcgccggcugcugcaacgacgaagcccucgaaugcguccccaccucagaaucaaacauaacaaugcaaaucaugcgcaucaaaccccaccaaucccaacacaucggagaaauguccuuccuccaacacucacgcugcgaaugccgcccaaaaaaagaccgcaccaaacccgaaaaaaaauccguacgcggcaaaggcaaaggccaaaaacgcaaacgcaaaaaaucccgcuucaaaucauggucaguccacugcgaacccugcagcgaacgacgcaaacaccucuucguccaagacccacaaacaugcaaaugcuccugcaaaaacacagacucgcgcugcaaagcccgccaacucgaacuaaacgaacgcaccugccgcugcgacaaaccccgacgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5466 - RNA, 977 nt, Artificial Sequence
  mRNA product Design3 comprising derived and/or modified sequence from Homo sapiens__NP_061986.1__HsFGF21(L126R,P199G,A208E) (opt11)
gggagagucccgcagucggcguccagcggcucugcuuguucgugugugugucguugcaggccuuauucaagcuuaccauggacuccgacgaaaccggcuucgaacacuccggccucugggucuccguccucgccggccuccuccuaggcgcaugccaagcccaccccauacccgacuccucaccccuccuccaauucggcggccaaguccgccaacgcuaccuauacaccgacgacgcccaacaaacagaagcccaccucgaaauccgagaagacggcacagucggcggcgccgccgaccaaagccccgaaucccuccuccaacucaaagcccucaaacccggcgucauccaaauccucggcgucaaaacaucccgcuuccuaugccaacgccccgacggcgcccucuacggcucacuccacuucgaccccgaagccugcuccuuccgcgaacgccuccucgaagacggcuacaacgucuaccaauccgaagcccacggccuaccccuacaccuccccggcaacaaauccccucaccgcgaccccgcaccccgcggccccgcccgcuuccuaccccuccccggccucccccccgcccuacccgaaccccccggcauccucgccccccaacccccagacgucggcuccucugacccccucuccauggucggcggcucccaaggccgcucacccuccuacgaauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5467 - RNA, 2534 nt, Artificial Sequence
  mRNA product Design3 comprising derived and/or modified sequence from Mus musculus__NP_001276387.1__MmHGF (opt11)
gggagagucccgcagucggcguccagcggcucugcuuguucgugugugugucguugcaggccuuauucaagcuuaccaugauguggggaacaaaauuacuaccaguccuacuacuccaacacguccuacuccaccuacuacuacuccacgucgcaauccccuacgccgaaggacagaaaaagcgaagaaacacacuacacgaauuuaagaaaucagccaaaaccacccuaaccaaagaagacccccuacugaaaaucaaaacuaagaaagucaacuccgcagaugagugcgcaaaccgaugcauacgcaaccgcggcuucacauucacuugcaaagccuucguuuucgacaaaucacgaaaacgcugcuacugguaccccuuuaacucgaugagcucaggcgugaagaaaggcuucggccaugaguucgaccuauacgaaaauaaagauuacauacguaacugcaucaucggaaaagguggcagcuacaaaggcacugucucaauaacgaaaaguggcaucaaaugccaacccuggaacuccaugaucccucacgaacacucauuccuccccuccagcuacagagggaaagaccuacaagaaaacuacugccguaauccaagaggagaagaaggcggaccuuggugcuucaccuccaaccccgaaguaagauacgaagugugcgacauaccacaaugcuccgaagucgaaugcaugaccugcaacggcgaauccuaccgaggacccauggaccacaccgaaucagguaagaccugccaacgcugggaccaacaaacaccccacagacacaaauuccucccugaacgcuaccccgacaaaggcuucgacgacaacuacugcaggaacccagacgguaaaccccgacccugguguuacacccucgacccagauacacccugggaauacugcgccauaaaaacaugcgcacacuccgccgucaacgagacagacguccccauggaaaccaccgagugcauacaaggacaaggggaaggauacagaggaacaucaaacaccauuuggaacggcauacccugccaaagaugggacucccaguauccccacaaacacgacaucacaccagaaaacuucaaaugcaaggaccuacgagaaaacuacugccgcaacccagacggagcugaaucccccuggugcuucacaacagacccgaauauccgcgucggauacuguucgcaaaucccaaagugcgacgucagcucaggacaagacugcuacagaggaaacggcaagaacuauaugggcaaccuuucgaaaacacgcagcggccuaaccugcuccaugugggacaagaacauggaagaccuccaccggcacauauucugggaacccgacgcaaguaaacuuaacaaaaacuacugucgcaauccggacgacgacgcccacggcccuuggugcuacaccgguaacccccuaaucccgugggacuacugccccauaucccgaugcgaaggagauacaacacccaccaucgugaaccuagaccaccccgucaucucaugcgcuaaaacgaaacagcuccgagucgucaacggcaucccaacgcaaacgaccgucggauggauggucucccugaaauaccgcaacaaacacauaugcggcggaagccuaauaaaagaaagcuggguccuuacagcccggcaaugcuucccagcccguaacaaagaccucaaagacuacgaagccuggcucggcauccacgacguacaugaacgaggggaagaaaaacgcaaacaaauacucaacaucucccagcugguauacggcccggaaggaagcgaccucguccucuugaaacuagccagacccgccauacuagacaacuucgucagcaccaucgaccuccccucauacggcugcaccaucccagaaaagacaaccugcucaaucuacggcuggggcuacaccggacuaaucaacgccgacggacuccugcgggucgcccauuuguacaucaugggaaacgaaaaaugcucccaacaccaccaaggcaaagucacccugaacgaauccgaacucugcgcaggcgccgagaaaaucggaucaggacccugcgaaggggacuacgggggcccccucaucugcgagcaacauaaaaugcguauggugcuaggcgugaucguccccggacgcggaugcgccaucccgaaccgccccgggaucuucguccgcgucgccuacuacgccaaauggauacauaaagucauucucaccuacaagcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5468 - RNA, 995 nt, Artificial Sequence
  mRNA product Design3 comprising derived and/or modified sequence from Homo sapiens__NP_002119.1__HsHMGB1 (opt11)
gggagagucccgcagucggcguccagcggcucugcuuguucgugugugugucguugcaggccuuauucaagcuuaccauggggaaaggggacccgaaaaagccgaggggaaagaugucgagcuaugccuucuucgugcaaacgugcagggaggaacacaagaaaaagcacccggacgcgagcgugaacuucagcgaguucucgaaaaagugcucggaaagguggaagaccaugagcgcgaaagagaaagggaaauuugaagauauggcgaaagcggacaaggcaagguacgagcgagagaugaagacauauauaccaccaaagggcgagaccaagaaaaaguucaaggacccgaacgcgcccaagcgcccgccaucggccuuuuucuuguucuguagcgaguacaggcccaagaucaagggagagcacccgggcuugagcauaggcgacgucgcgaaaaagcucggggaaauguggaauaacacggccgcggacgauaaacagccauaugaaaagaaagcggccaagcuaaaggaaaaguacgagaaagauaucgcggcauaucgcgcgaaagggaaaccggacgcggccaagaaaggagucguaaaagcggaaaagagcaagaaaaagaaagaggaagaggaagaugaagaggacgaggaagaugaagaggaagaggaagaugaagaggacgaggacgaggaagaggacgaugacgaugaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5469 - RNA, 992 nt, Artificial Sequence
  mRNA product Design3 comprising derived and/or modified sequence from Mus musculus__NP_001273985.1__MmVEGFA (opt11)
gggagagucccgcagucggcguccagcggcucugcuuguucgugugugugucguugcaggccuuauucaagcuuaccaugaacuuccuccuauccuggguccacuggacacucgcccuccuccucuaccuccaccacgccaaauggucccaagcagcacccaccacagaaggcgaacaaaaaucccacgaagucaucaaguucauggacgucuaccaacgcucauacugccgccccaucgaaacacucguagacaucuuccaagaauaccccgacgaaaucgaauacaucuucaaacccuccugcgucccacuaaugcgcugcgccggaugcugcaacgacgaagcccucgaaugcgucccaaccuccgaauccaacaucaccaugcaaaucaugcgcaucaaaccccaccaaucccaacacaucggcgaaauguccuuccuccaacacucccgcugcgaaugccgccccaaaaaagaccgcaccaaacccgaaaaaaaaucaguccgcggcaaaggcaaaggucaaaaacgaaaacgcaaaaaaucacgcuucaaauccugguccguccacugcgaacccugcucagaacgacgcaaacaccucuucguccaagacccccaaaccugcaaaugcucaugcaaaaacaccgacucccgaugcaaagcccgccaacucgaacucaacgaacgaaccugccgcugcgacaaaccccgacgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5470 - RNA, 977 nt, Artificial Sequence
  mRNA product Design3 comprising derived and/or modified sequence from Homo sapiens__NP_061986.1__HsFGF21(L126R,P199G,A208E) (opt12)
gggagagucccgcagucggcguccagcggcucugcuuguucgugugugugucguugcaggccuuauucaagcuuaccauggacucugacgaaacagguuucgaacacucaggacuaugggucucaguauuagcaggacuauuauuaggagcaugucaagcacauccaauaccagacucaucaccacuacuacaauucggcggacaaguaagacaaagauacuuauacacagacgaugcacaacaaacagaagcacauuuagaaauaagagaagauggcacaguaggcggagcagcagaccaaucaccagaaucacuauuacaauuaaaagcauuaaaaccaggaguaauacaaauauuaggaguaaaaacaucaagauucuuaugucaaagaccugacggagcacuauacggaucacuacacuuugacccagaagcaugcucauuuagagaaagauuauuagaagacggauacaauguauaucaaucagaagcacacggauuaccauuacacuuacccggaaauaaaucaccacauagagacccagcaccaagaggaccugcaagauuucuaccucuaccaggacuaccaccagcacuaccugaaccaccaggaauauuagcaccacaaccaccagacguaggauccucagaccccuuaucaaugguaggcggaucacaaggaagaucaccaucauaugaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5471 - RNA, 2534 nt, Artificial Sequence
  mRNA product Design3 comprising derived and/or modified sequence from Mus musculus__NP_001276387.1__MmHGF (opt12)
gggagagucccgcagucggcguccagcggcucugcuuguucgugugugugucguugcaggccuuauucaagcuuaccaugauguggggaacuaaauuacuaccaguucuauuacuucaacacguccuauuacauuuauuacuauuacacguugcaauaccauaugcagaaggacaaaaaaaaagaaggaacaccuuacacgaauuuaaaaaaucggcaaaaacaacccucacaaaggaagacccacuauuaaaaaucaaaacaaaaaaagugaauagugcagacgaaugugcaaauagaugcauaagaaacagaggauuuacauucacuuguaaagcauuuguauuugauaaaucaaggaaaagguguuauugguauccuuuuaacucaaugucuaguggaguaaaaaaaggauucggacaugaauuugaccuauaugaaaauaaagacuauauaagaaauugcauaauaggaaaagguggaucauauaaagggacaguuagcauaaccaaaucaggcauaaaaugucaaccauggaauucaaugauaccacaugaacauuccuuucuaccuaguaguuaucguggaaaagauuuacaagaaaauuauuguagaaacccaagaggagaagaaggagggccauggugcuuuacaagcaacccagaagucagauaugaaguaugugacauaccacaauguucagaaguagaauguaugacaugcaauggagaaucguauagagguccaauggaccauacagaaucaggaaaaacaugucaaagaugggaucaacaaaccccacaucgacauaaauucuuaccagaacgauauccagacaaaggguucgacgauaauuauugcagaaauccagaugggaaaccaagacccugguguuacacucuagaccccgauacaccaugggaauauugugcaauaaaaacaugcgcacacucagcaguaaaugagacugaugucccaauggaaacuacagaaugcauucaaggacaaggugaagguuaccgaggcacaaguaauacuauauggaaugggauaccaugucaaagaugggacagucaauacccacauaaacaugauauaacgccagaaaauuuuaaauguaaagauuuaagagaaaauuauugcagaaauccugauggcgcggaaaguccauggugcuucacaacugauccuaacauaagaguugguuauugcagucaaauaccuaaaugcgauguaucauccggacaagauuguuauagggguaauggaaaaaauuauaugggcaauuuaucaaaaacacguaguggauuaacauguucaaugugggauaaaaauauggaagauuuacaucgacacauuuucugggaacccgaugcuaguaaauuaaacaaaaacuauugucgaaacccagaugaugaugcacauggaccauggugcuauacagguaacccacuuauaccaugggacuauuguccuauaucaagaugugaaggcgauacaacaccuacuauagucaauuuagaucauccuguaaucaguugcgcuaaaacaaaacaauuaagaguuguaaacggaauuccaacacaaacaacaguaggauggaugguaucacucaaauaccgaaauaaacacauaugcggagguucuuuaauaaaagaaagcuggguauuaaccgcaagacaaugcuucccggcaagaaauaaagauuuaaaagauuaugaagcaugguuaggaauacacgauguacacgaaaggggagaagaaaaaagaaaacaaauacuaaauauaucacaauuaguauacggcccagaagggagcgaucuaguucuucuaaaauuagccagaccagcaauauuagauaauuuuguaucuacuaucgaucuaccaucauauggauguacaauaccugagaaaacaacauguucaauauauggauggggauauacuggauuaauaaacgccgauggacuucuuagaguagcacacuuauauauaaugggaaacgaaaaaugcucacaacaucaucaaggaaaaguuacacuaaacgaaucagaacuaugugcuggcgcagaaaaaaucggaucaggcccaugcgaaggugauuacggcggaccacuuauaugugaacaacauaaaaugcgcaugguauuaggagucauaguucccggucggggcugugcgauaccaaacagaccaggcauauuuguccguguagccuacuaugcaaaauggauacauaaaguaauauuaacauauaaauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5472 - RNA, 995 nt, Artificial Sequence
  mRNA product Design3 comprising derived and/or modified sequence from Homo sapiens__NP_002119.1__HsHMGB1 (opt12)
gggagagucccgcagucggcguccagcggcucugcuuguucgugugugugucguugcaggccuuauucaagcuuaccaugggaaaaggagacccaaaaaaaccaagaggaaaaaugucaagcuacgcauucuucguacaaacaugcagagaagaacacaaaaaaaaacacccagacgcaagcguaaacuucagcgaauucagcaaaaaaugcucagaaagguggaaaacaaugagcgcaaaagagaaaggaaaauucgaagacauggcaaaagcagacaaagcaagauacgaaagagaaaugaaaacauacauaccaccaaaaggagaaacaaaaaaaaaauuuaaagacccaaacgcaccaaaaagaccaccaucagcauucuuccuauucugcagugaauacagaccaaaaauaaaaggagaacacccaggacuaagcauaggagacguagcaaaaaaauuaggagaaauguggaacaacacagcagcagacgacaaacaaccauacgaaaaaaaagcagcaaaauuaaaagaaaaauacgaaaaggacauagcagcauaucgagcaaaaggaaaaccagacgcagcaaaaaaaggaguaguaaaagcagaaaaaagcaaaaaaaaaaaagaagaagaagaagacgaagaagacgaagaagacgaagaagaagaagaagacgaagaagacgaagacgaagaagaagacgacgacgacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5473 - RNA, 992 nt, Artificial Sequence
  mRNA product Design3 comprising derived and/or modified sequence from Mus musculus__NP_001273985.1__MmVEGFA (opt12)
gggagagucccgcagucggcguccagcggcucugcuuguucgugugugugucguugcaggccuuauucaagcuuaccaugaacuuccuacuaucauggguacacuggacacuagcauuacuacuauacuuacaccacgcaaaauggucacaagcagcaccaacaacagaaggagaacaaaaaucacacgaaguaauaaaauucauggacguauaccaacgaucauacugcagaccaauagaaacacuaguagacauauuccaagaauacccagacgaaauagaauacauauucaaaccaucaugcguaccauuaaugagaugcgcaggaugcugcaacgacgaagcauuagaaugcguaccaacaucagaaucaaacauaacaaugcaaauaaugagaauaaaaccacaccaaucacaacacauaggagaaaugucauuccuacaacauucaagaugcgaaugcagaccaaaaaaagacagaacaaaaccagaaaaaaaaucaguaagaggaaaaggaaaaggacaaaaaagaaaaagaaaaaaaucaagauucaaaucauggucaguacacugcgaaccaugcucagaacgaagaaaacacuuauuuguacaagacccacaaacaugcaaaugcucaugcaaaaacacagacucaagaugcaaagcaagacaacuagaacuaaaugaaagaacaugcagaugugacaaaccaagacgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5474 - RNA, 977 nt, Artificial Sequence
  mRNA product Design3 comprising derived and/or modified sequence from Homo sapiens__NP_061986.1__HsFGF21(L126R,P199G,A208E) (opt13)
gggagagucccgcagucggcguccagcggcucugcuuguucgugugugugucguugcaggccuuauucaagcuuaccauggacucagacgaaacaggauuugaacacucaggacuauggguaucaguacuagcaggauuauuacuaggagccugccaagcacacccaauaccagacucaucaccauuauuacaauucggaggacaaguuagacaaagauaucuauauacagaugacgcacaacaaacagaagcacacuuagaaauaagagaagacggaacaguaggaggagcagcagaccaaucaccagaaucccuacuacaauuaaaagcacuaaaaccaggaguaauacaaauauuaggaguaaaaacaucaagauuccuaugccaaagaccagacggagcacuauacggcucacuacacuuugacccagaagcaugcucauucagagaaagacuacuagaagacggauauaauguauaucaaucagaagcacacggacuaccuuuacauuuaccaggaaacaaaucaccacacagagacccagcaccaagaggcccagcacgcuuuuuaccauuaccaggacuaccaccagcauuaccagaaccaccaggaauacuagcaccacaaccaccagauguuggaagcucagacccacuaucaaugguaggaggaucacaaggaagaucaccaucauaugaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5475 - RNA, 2534 nt, Artificial Sequence
  mRNA product Design3 comprising derived and/or modified sequence from Mus musculus__NP_001276387.1__MmHGF (opt13)
gggagagucccgcagucggcguccagcggcucugcuuguucgugugugugucguugcaggccuuauucaagcuuaccaugauguggggaacaaaacuuuuaccuguucuauuauuacaacacguccuguuacacuuauuauuacuacauguagccauaccuuacgcagaaggacaaaagaaacgaagaaacacacuucaugaauuuaagaaauccgcaaaaacaacauuaacaaaagaagauccauuauuaaaaauaaaaacaaagaaaguuaauucagcagaugaaugugcaaauagauguauaagaaacagaggauuuaccuuuacauguaaagcauuuguauucgacaaaucaaggaaacgauguuacugguauccauucaauaguaugaguucuggaguaaagaaaggauucggucaugaguucgaccuauaugaaaauaaagacuauauuagaaauuguauaaucggcaaaggugggucuuauaaaggcacuguuaguauaacaaaaucaggaauaaaaugucaaccauggaauagcaugauaccacacgaacacucauuucucccaucuucauacaggggcaaagaccuacaagaaaauuauuguagaaacccaaggggagaagaaggaggcccaugguguuuuacaucgaauccugaaguacgauaugaaguaugugacaucccccaaugcagugaaguagaauguaugacuuguaauggugaaucauaccgaggaccuauggaccauacagaaucaggaaaaacuugccaacgaugggaucaacaaaccccucaucgacacaaauuuuuaccagaacguuacccagauaaaggauuugacgauaauuacuguagaaauccagacgguaaaccucgacccugguguuacacucuugauccagauacaccaugggaauauugcgcaauaaaaacuugcgcacauucugcaguaaaugaaacagacguuccaauggaaacuaccgaauguauacaaggccaaggagaaggcuauagagguacaucaaauacaauauggaauggcauacccugccaaaggugggacucucaauauccacauaaacaugauauaacaccagaaaacuuuaaauguaaagauuuaagagaaaauuacuguagaaauccggauggagcagaaucucccugguguuucacuaccgauccuaacauaagaguaggauauuguagccaaauaccuaaaugugauguuagcucaggucaagacugcuacagagguaauggcaaaaauuacauggggaaucucaguaaaacacguaguggacucacauguucaaugugggauaaaaauauggaagaccugcacagacauauauucugggaaccugaugcuucaaaauuaaauaaaaauuauugcagaaauccagaugaugacgcucacggaccaugguguuacacugguaauccauuaauaccaugggauuauuguccaauaucaagaugcgaaggugauacaacuccaacaauaguaaaucuagaucauccaguaauauccugugcaaaaacaaaacaacuaagaguaguaaacggaauaccaacacaaacaacaguaggauggaugguuaguuuaaaauacagaaauaaacauauauguggaggauccuuaauaaaagaaucauggguauuaacugcaagacaauguuucccagcaaggaacaaagauuuaaaagauuacgaagcauggcuaggaauacaugauguucacgaaagaggagaagaaaaacguaaacaaauuuugaacauuucacaacuuguauacggcccagaaggaucugauuuaguauuauuaaaguuagcaagaccagcaauucucgauaauuucguaucaacgauagaucuccccaguuacggcuguacgauaccagaaaagacaacaugcaguauauacggauggggauauacaggacuaaucaacgcagauggacuuuuaagaguagcccacuuauauauaauggguaacgaaaaauguucacaacaucaucaaggaaaaguaacacuaaaugaaagcgaauuaugugcaggcgcagagaaaauaggaagcggaccuugugaaggcgauuacgguggaccacuaauaugugaacaacauaaaaugagaaugguauuaggaguaauaguuccaggacguggaugugccauaccaaaccgaccaggaauauuuguuaggguagccuacuacgcaaaauggauucacaaaguaauauuaacauauaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5476 - RNA, 995 nt, Artificial Sequence
  mRNA product Design3 comprising derived and/or modified sequence from Homo sapiens__NP_002119.1__HsHMGB1 (opt13)
gggagagucccgcagucggcguccagcggcucugcuuguucgugugugugucguugcaggccuuauucaagcuuaccaugggaaaaggagacccaaaaaaaccgagaggaaaaaugagcagcuacgcauuuuucguacaaacaugcagagaagaacacaaaaaaaaacacccagacgcaagcguaaacuuuagcgaauuuucaaaaaaaugcucagaaagauggaaaacaaugagcgcaaaagaaaaaggaaaauucgaagacauggcgaaagcagacaaagcaagauaugaaagagaaaugaaaacauacauaccaccaaaaggagaaaccaaaaaaaaauuuaaagacccaaacgcaccaaaaagaccaccaagcgcauucuuucuauucugcagugaauacagaccaaaaauaaaaggagaacacccaggauuaagcauaggagacguagcaaaaaaacuaggagaaauguggaacaacacagcagcagacgacaaacaaccauacgaaaaaaaagcagcaaaacuaaaagaaaaauacgaaaaagacauagcagcauauagagcaaaaggaaaaccagacgcagcaaaaaaaggaguaguaaaagcagaaaaaagcaaaaaaaaaaaagaagaagaagaagacgaagaagacgaagaagacgaagaagaagaagaagacgaagaagacgaagacgaagaagaagacgacgacgacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5477 - RNA, 992 nt, Artificial Sequence
  mRNA product Design3 comprising derived and/or modified sequence from Mus musculus__NP_001273985.1__MmVEGFA (opt13)
gggagagucccgcagucggcguccagcggcucugcuuguucgugugugugucguugcaggccuuauucaagcuuaccaugaacuuccuacuaucauggguacacuggacacuagcacuacuacuauacuuacaccacgcaaaauggagucaagcagcaccaacaacagaaggagaacaaaaaagccacgaaguaauaaaauucauggacguauaucaacgaucauacugcagaccaauagaaacacuaguagauaucuuccaagaauacccagacgaaauagaauacauauucaaaccaucaugcguaccauuaaugagaugcgcaggaugcugcaacgacgaagcacuagaaugcguaccaacaucagaaucaaacauaacaaugcaaauaaugagaauaaaaccccaccaaagccaacacauaggagaaaugucauuccuacaacacucaagaugcgaaugcagacccaaaaaagaccgaacaaaaccagaaaaaaaaucaguaagaggaaaaggaaaaggacaaaaaagaaaacgaaaaaaaucacgauucaaaucauggucaguacacugcgaaccaugcucugaaagaagaaaacaccuauucguacaagacccacaaacauguaaaugcagcugcaaaaacacagacucaagaugcaaagcaagacaacuagaauuaaacgaaagaacaugcagaugcgacaaaccacgaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5478 - RNA, 906 nt, Artificial Sequence
  mRNA product Design5 comprising derived and/or modified sequence from Homo sapiens__NP_061986.1__HsFGF21(L126R,P199G,A208E) (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5479 - RNA, 906 nt, Artificial Sequence
  mRNA product Design5 comprising derived and/or modified sequence from Homo sapiens__NP_061986.1__HsFGF21(L126R,P199G,A208E) (wt) R5988/R6155/R6227
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5480 - RNA, 2463 nt, Artificial Sequence
  mRNA product Design5 comprising derived and/or modified sequence from Mus musculus__NP_001276387.1__MmHGF (wt)
gggagagucccgcagucggcguccagcggcucugcuuguucgugugugugucguugcaggccuuauucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaauuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauucccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcuuggcuuggcauccacgauguucaugagagaggcgaggagaagcgcaagcagaucuuaaacauuucccagcuggucuaugguccugaaggcucagacuugguuuuacugaagcuugcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5481 - RNA, 2463 nt, Artificial Sequence
  mRNA product Design5 comprising derived and/or modified sequence from Mus musculus__NP_001276387.1__MmHGF (wt)
gggagagucccgcagucggcguccagcggcucugcuuguucgugugugugucguugcaggccuuauucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaacuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauccccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcauggcuuggcauccacgauguucaugagagaggcgaggagaagcgcaagcagaucuuaaacauuucccagcuggucuaugguccugaaggcucagacuugguuuuacugaagcuggcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5482 - RNA, 924 nt, Artificial Sequence
  mRNA product Design5 comprising derived and/or modified sequence from Homo sapiens__NP_002119.1__HsHMGB1 (wt)
gggagagucccgcagucggcguccagcggcucugcuuguucgugugugugucguugcaggccuuauucaagcuuaccaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaagcggacaaggcccguuaugaaagagaaaugaaaaccuauaucccucccaaaggggagacaaaaaagaaguucaaggaucccaaugcacccaagaggccuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaugaagaagaagaugaugaugaugaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5483 - RNA, 921 nt, Artificial Sequence
  mRNA product Design5 comprising derived and/or modified sequence from Mus musculus__NP_001273985.1__MmVEGFA (wt)
gggagagucccgcagucggcguccagcggcucugcuuguucgugugugugucguugcaggccuuauucaagcuuaccaugaacuuucugcucucuugggugcacuggacccuggcuuuacugcuguaccuccaccaugccaaguggucccaggcugcacccacgacagaaggagagcagaagucccaugaagugaucaaguucauggaugucuaccagcgaagcuacugccguccgauugagacccugguggacaucuuccaggaguaccccgacgagauagaguacaucuucaagccguccugugugccgcugaugcgcugugcaggcugcuguaacgaugaagcccuggagugcgugcccacgucagagagcaacaucaccaugcagaucaugcggaucaaaccucaccaaagccagcacauaggagagaugagcuuccuacagcacagcagaugugaaugcagaccaaagaaagacagaacaaagccagaaaaaaaaucaguucgaggaaagggaaagggucaaaaacgaaagcgcaagaaaucccgguuuaaauccuggagcguucacugugagccuuguucagagcggagaaagcauuuguuuguccaagauccgcagacguguaaauguuccugcaaaaacacagacucgcguugcaaggcgaggcagcuugaguuaaacgaacguacuugcagaugugacaagccaaggcggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5484 - RNA, 906 nt, Artificial Sequence
  mRNA product Design5 comprising derived and/or modified sequence from Homo sapiens__NP_061986.1__HsFGF21(L126R,P199G,A208E) (opt1)
gggagagucccgcagucggcguccagcggcucugcuuguucgugugugugucguugcaggccuuauucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcgccugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggggcucccagggccggagccccuccuacgagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5485 - RNA, 2463 nt, Artificial Sequence
  mRNA product Design5 comprising derived and/or modified sequence from Mus musculus__NP_001276387.1__MmHGF (opt1) R6151/R6224
gggagagucccgcagucggcguccagcggcucugcuuguucgugugugugucguugcaggccuuauucaagcuuaccaugauguggggcaccaagcugcuccccgugcugcugcuccagcacguccugcugcaccuccugcugcuccacguggccaucccguacgccgaggggcagaagaagcgccggaacacccugcacgaguucaagaagagcgcgaagacgacccugaccaaggaggacccccuccugaagaucaagaccaagaaggugaacuccgccgacgagugcgccaaccgcugcauccggaaccgcggcuucacguucaccugcaaggccuucgucuucgacaagagccggaagcgcugcuacugguaccccuucaacuccaugagcuccggggugaagaagggcuucgggcacgaguucgaccuguacgagaacaaggacuacauccggaacugcaucaucggcaagggcgggagcuacaagggcaccguguccaucaccaagagcgggaucaagugccagcccuggaacuccaugaucccgcacgagcacagcuuccuccccuccagcuaccgcggcaaggaccugcaggagaacuacugccggaacccccgcggggaggagggcggccccuggugcuucacguccaacccggagguccgguacgaggugugcgacaucccccagugcagcgagguggagugcaugaccugcaacggggaguccuaccgcggccccauggaccacaccgagagcgggaagaccugccagcggugggaccagcagacgccccaccgccacaaguuccugccggagcgguaccccgacaagggcuucgacgacaacuacugccgcaaccccgacggcaagccccggccguggugcuacacccucgaccccgacacccccugggaguacugcgccaucaagaccugcgcgcacuccgccgucaacgagacggacgugcccauggagaccaccgagugcauccaggggcagggcgagggguaccgcggcaccagcaacacgaucuggaacgggaucccgugccagcggugggacucccaguacccccacaagcacgacaucacccccgagaacuucaagugcaaggaccugcgcgagaacuacugccggaaccccgacggcgccgagagcccguggugcuucaccaccgaccccaacauccgcgugggcuacugcagccagauccccaagugcgacgucuccagcgggcaggacugcuaccgcggcaacgggaagaacuacaugggcaaccuguccaagacgcggagcgggcucaccugcuccaugugggacaagaacauggaggaccugcaccgccacaucuucugggagcccgacgccagcaagcugaacaagaacuacugccggaacccggacgacgacgcgcacggccccuggugcuacaccggcaacccccucaucccgugggacuacugccccaucucccgcugcgagggggacaccacgcccaccaucgugaaccuggaccaccccgugaucagcugcgccaagaccaagcagcugcgggucgugaacggcaucccgacccagacgaccgugggguggauggucucccucaaguaccgcaacaagcacaucugcggcgggagccugaucaaggaguccugggugcugaccgcccggcagugcuuccccgcccgcaacaaggaccucaaggacuacgaggccuggcugggcauccacgacgugcacgagcggggcgaggagaagcgcaagcagauccugaacaucagccagcucgucuacgggcccgagggcuccgaccuggugcugcucaagcuggcgcggcccgccauccuggacaacuucgugagcaccaucgaccucccguccuacgggugcacgauccccgagaagaccaccugcagcaucuacggcuggggcuacaccgggcugaucaacgccgacggccugcuccgcgucgcccaccuguacaucauggggaacgagaagugcucccagcaccaccagggcaaggugacccugaacgagagcgagcucugcgccggggcggagaagaucggcuccggccccugcgagggggacuacggcgggccccugaucugcgagcagcacaagaugcggaugguccugggcgugaucgugccggggcgcggcugcgccauccccaaccggcccggcaucuucguccgcguggccuacuacgccaaguggauccacaaggugauccugacguacaagcucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5486 - RNA, 924 nt, Artificial Sequence
  mRNA product Design5 comprising derived and/or modified sequence from Homo sapiens__NP_002119.1__HsHMGB1 (opt1)
gggagagucccgcagucggcguccagcggcucugcuuguucgugugugugucguugcaggccuuauucaagcuuaccaugggcaagggggaccccaagaagccgcgcggcaagaugagcagcuacgccuucuucgugcagaccugccgggaggagcacaagaagaagcaccccgacgccagcgucaacuucuccgaguucagcaagaagugcuccgagcgcuggaagaccaugagcgcgaaggagaaggggaaguucgaggacauggccaaggccgacaaggcccgguacgagcgcgagaugaagacguacaucccgcccaagggcgagaccaagaagaaguucaaggaccccaacgcccccaagcggccgcccuccgcguucuuccuguucugcagcgaguaccgccccaagaucaagggggagcaccccggccucuccaucggcgacguggccaagaagcugggggagauguggaacaacaccgccgccgacgacaagcagcccuacgagaagaaggcggccaagcugaaggagaaguacgagaaggacaucgccgccuaccgggccaagggcaagcccgacgcggccaagaaggggguggucaaggccgagaaguccaagaagaagaaggaggaggaggaggacgaggaggacgaggaggacgaggaggaggaggaggacgaggaggacgaggacgaggaggaggacgacgacgacgagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5487 - RNA, 921 nt, Artificial Sequence
  mRNA product Design5 comprising derived and/or modified sequence from Mus musculus__NP_001273985.1__MmVEGFA (opt1) R6152
gggagagucccgcagucggcguccagcggcucugcuuguucgugugugugucguugcaggccuuauucaagcuuaccaugaacuuccugcucagcugggugcacuggacccuggcccugcuccuguaccugcaccacgcgaaguggucgcaggccgccccgacgaccgagggcgagcagaagagccacgaggucaucaaguucauggacguguaccagcggagcuacugccgccccaucgagacccucguggacaucuuccaggaguacccggacgagaucgaguacaucuucaagccgucgugcgucccccugaugcggugcgcggggugcugcaacgacgaggcccuggagugcgugccgacgagcgagagcaacaucaccaugcagaucaugcggaucaagccgcaccagucgcagcacaucggcgagaugagcuuccuccagcacagccgcugcgagugccggcccaagaaggaccggaccaagccggagaagaagucggugcgcggcaaggggaagggccagaagcggaagcggaagaagagccgcuucaagagcuggucgguccacugcgagccgugcagcgagcggcggaagcaccuguucgugcaggacccccagacgugcaagugcagcugcaagaacaccgacucgcgcugcaaggcccggcagcuggagcucaacgagcggaccugccgcugcgacaagccgcggcggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5488 - RNA, 906 nt, Artificial Sequence
  mRNA product Design5 comprising derived and/or modified sequence from Homo sapiens__NP_061986.1__HsFGF21(L126R,P199G,A208E) (opt2)
gggagagucccgcagucggcguccagcggcucugcuuguucgugugugugucguugcaggccuuauucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcgccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggcggcucccagggccgcucccccuccuacgaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5489 - RNA, 2463 nt, Artificial Sequence
  mRNA product Design5 comprising derived and/or modified sequence from Mus musculus__NP_001276387.1__MmHGF (opt2)
gggagagucccgcagucggcguccagcggcucugcuuguucgugugugugucguugcaggccuuauucaagcuuaccaugauguggggcaccaagcuccuccccguccuccuccuccagcacguccuccuccaccuccuccuccuccacgucgccauccccuacgccgagggccagaagaagcgccgcaacacccuccacgaguucaagaaguccgccaagaccacccucaccaaggaggacccccuccucaagaucaagaccaagaaggucaacuccgccgacgagugcgccaaccgcugcauccgcaaccgcggcuucaccuucaccugcaaggccuucgucuucgacaagucccgcaagcgcugcuacugguaccccuucaacuccauguccuccggcgucaagaagggcuucggccacgaguucgaccucuacgagaacaaggacuacauccgcaacugcaucaucggcaagggcggcuccuacaagggcaccgucuccaucaccaaguccggcaucaagugccagcccuggaacuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccccauggaccacaccgaguccggcaagaccugccagcgcugggaccagcagaccccccaccgccacaaguuccuccccgagcgcuaccccgacaagggcuucgacgacaacuacugccgcaaccccgacggcaagccccgccccuggugcuacacccucgaccccgacacccccugggaguacugcgccaucaagaccugcgcccacuccgccgucaacgagaccgacguccccauggagaccaccgagugcauccagggccagggcgagggcuaccgcggcaccuccaacaccaucuggaacggcauccccugccagcgcugggacucccaguacccccacaagcacgacaucacccccgagaacuucaagugcaaggaccuccgcgagaacuacugccgcaaccccgacggcgccgagucccccuggugcuucaccaccgaccccaacauccgcgucggcuacugcucccagauccccaagugcgacgucuccuccggccaggacugcuaccgcggcaacggcaagaacuacaugggcaaccucuccaagacccgcuccggccucaccugcuccaugugggacaagaacauggaggaccuccaccgccacaucuucugggagcccgacgccuccaagcucaacaagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccagaccaccgucggcuggauggucucccucaaguaccgcaacaagcacaucugcggcggcucccucaucaaggaguccuggguccucaccgcccgccagugcuuccccgcccgcaacaaggaccucaaggacuacgaggccuggcucggcauccacgacguccacgagcgcggcgaggagaagcgcaagcagauccucaacaucucccagcucgucuacggccccgagggcuccgaccucguccuccucaagcucgcccgccccgccauccucgacaacuucgucuccaccaucgaccuccccuccuacggcugcaccauccccgagaagaccaccugcuccaucuacggcuggggcuacaccggccucaucaacgccgacggccuccuccgcgucgcccaccucuacaucaugggcaacgagaagugcucccagcaccaccagggcaaggucacccucaacgaguccgagcucugcgccggcgccgagaagaucggcuccggccccugcgagggcgacuacggcggcccccucaucugcgagcagcacaagaugcgcaugguccucggcgucaucguccccggccgcggcugcgccauccccaaccgccccggcaucuucguccgcgucgccuacuacgccaaguggauccacaaggucauccucaccuacaagcucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5490 - RNA, 924 nt, Artificial Sequence
  mRNA product Design5 comprising derived and/or modified sequence from Homo sapiens__NP_002119.1__HsHMGB1 (opt2)
gggagagucccgcagucggcguccagcggcucugcuuguucgugugugugucguugcaggccuuauucaagcuuaccaugggcaagggcgaccccaagaagccccgcggcaagauguccuccuacgccuucuucguccagaccugccgcgaggagcacaagaagaagcaccccgacgccuccgucaacuucuccgaguucuccaagaagugcuccgagcgcuggaagaccauguccgccaaggagaagggcaaguucgaggacauggccaaggccgacaaggcccgcuacgagcgcgagaugaagaccuacaucccccccaagggcgagaccaagaagaaguucaaggaccccaacgcccccaagcgcccccccuccgccuucuuccucuucugcuccgaguaccgccccaagaucaagggcgagcaccccggccucuccaucggcgacgucgccaagaagcucggcgagauguggaacaacaccgccgccgacgacaagcagcccuacgagaagaaggccgccaagcucaaggagaaguacgagaaggacaucgccgccuaccgcgccaagggcaagcccgacgccgccaagaagggcgucgucaaggccgagaaguccaagaagaagaaggaggaggaggaggacgaggaggacgaggaggacgaggaggaggaggaggacgaggaggacgaggacgaggaggaggacgacgacgacgagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5491 - RNA, 921 nt, Artificial Sequence
  mRNA product Design5 comprising derived and/or modified sequence from Mus musculus__NP_001273985.1__MmVEGFA (opt2)
gggagagucccgcagucggcguccagcggcucugcuuguucgugugugugucguugcaggccuuauucaagcuuaccaugaacuuccuccucuccuggguccacuggacccucgcccuccuccucuaccuccaccacgccaaguggucccaggccgcccccaccaccgagggcgagcagaagucccacgaggucaucaaguucauggacgucuaccagcgcuccuacugccgccccaucgagacccucgucgacaucuuccaggaguaccccgacgagaucgaguacaucuucaagcccuccugcgucccccucaugcgcugcgccggcugcugcaacgacgaggcccucgagugcguccccaccuccgaguccaacaucaccaugcagaucaugcgcaucaagccccaccagucccagcacaucggcgagauguccuuccuccagcacucccgcugcgagugccgccccaagaaggaccgcaccaagcccgagaagaaguccguccgcggcaagggcaagggccagaagcgcaagcgcaagaagucccgcuucaaguccugguccguccacugcgagcccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5492 - RNA, 906 nt, Artificial Sequence
  mRNA product Design5 comprising derived and/or modified sequence from Homo sapiens__NP_061986.1__HsFGF21(L126R,P199G,A208E) (opt3)
gggagagucccgcagucggcguccagcggcucugcuuguucgugugugugucguugcaggccuuauucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugagagauuacuggaagauggguauaacgucuaccagagcgaggcacacggacuucccuugcaucugccugguaauaaaaguccacacagggaccccgccccucggggcccagcucgcuuucuaccgcuccccgggcugccuccagcccuucccgaaccuccaggcauucuggcgccccagccgccugaugugggauccucugaccccuugagcaugguuggugggucccagggaagaucaccaaguuaugagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5493 - RNA, 2463 nt, Artificial Sequence
  mRNA product Design5 comprising derived and/or modified sequence from Mus musculus__NP_001276387.1__MmHGF (opt3)
gggagagucccgcagucggcguccagcggcucugcuuguucgugugugugucguugcaggccuuauucaagcuuaccaugauguggggcaccaagcugcuccccgugcuucuguugcagcacgucuuacugcaucuacuccugcuucacguugccaucccuuacgcugaggggcaaaagaagagaaggaacacacugcaugaguucaaaaagagcgcaaaaacuacguugaccaaggaggacccacuccugaagauuaaaacaaagaaaguaaauuccgccgaugaaugcgcgaaccgguguauacgcaaucgaggauuuacuuuuaccugcaaggcuuucguguucgacaaaucucguaagagauguuauugguacccguuuaacucaaugaguagcggugugaagaaaggcuucgggcacgaguuugaucuguaugaaaauaaggacuacaucaggaacugcauuaucggaaaaggcgguuccuauaaggggacagucucuauuaccaaaucgggaaucaagugucagcccuggaacucaaugauaccucaugagcacagcuuccucccaaguuccuaccggggcaaagauuuacaggagaauuauugccgcaaucccagaggcgaagaagggggaccuugguguuuuacuucuaacccagaagugagguacgagguuugcgacaucccccaguguagcgagguggaaugcaugacauguaauggugaguccuaccggggcccuauggaucacaccgaaucagggaagacgugccaacgcugggaccagcagacuccacaucgacacaaguuccugccggagagauaucccgauaaaggauuugacgauaacuacugcaggaauccugacggcaagccacggcccugguguuauacccuugauccugacacaccaugggaauacugcgccauuaaaacuugugcacauagugccgucaacgagaccgacgugcccauggagacaaccgaaugcauccagggucaaggggagggauaucguggcacgagcaauacuauuuggaacggcaucccgugucagcgcugggauucucaguacccucacaagcacgacauaacacccgaaaacuucaaaugcaaggauuugagagagaauuauuguaggaacccagacggggcugaauccccuuggugcuuuaccacugaucccaauauucggguaggauacuguucacagaucccaaagugcgacguuagcaguggucaagauuguuaccgaggcaacgggaaaaauuauaugggaaaccugucuaagacacgcuccggccuaaccugcagcaugugggacaaaaauauggaggaucuccauagacacauuuucugggagcccgacgcaucgaagcugaacaaaaauuacugcaggaacccugaugacgacgcccaugguccaugguguuauacggggaauccgcuuauccccugggauuacugcccuaucucucggugugaaggcgacaccacaccaacuauugugaaccuggaucaccccgucauauccugcgcuaagaccaagcaguugcgcguggugaauggaaucccuacacagacuaccgucggcuggaugguuucacucaaauauagaaacaagcauauuugugggggaagucugaucaaagagagcuggguguuaacagccaggcaaugcuucccagcgcguaauaaggaccugaaagauuacgaagcauggcucgguauacacgacguacacgagcggggcgaagagaagcgaaagcagauucuuaacaucucccagcugguguaugggcccgagggaucugauuugguccuacugaaacucgccagaccggcuauccuggacaacuuugugagcaccauugaucuuccuucauacggcuguacuaucccagaaaagacgacaugcaguauuuacgguuggggguauaccggccugauaaaugccgacggauugcucaggguugcacaucuguacaucaugggcaacgagaaauguucccagcaccaucaagggaaggugacuuuaaaugaaagcgagcugugcgcuggagccgagaaaauugguucuggccccugugaaggggauuauggaggcccucuaaucugcgagcagcacaagaugcgcaugguccucggugugaucguacccgggcggggcugcgcgauuccaaacagaccuggaauauucguuaggguggccuacuaugcaaaauggauccacaaggucauucugaccuacaaacuuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5494 - RNA, 924 nt, Artificial Sequence
  mRNA product Design5 comprising derived and/or modified sequence from Homo sapiens__NP_002119.1__HsHMGB1 (opt3)
gggagagucccgcagucggcguccagcggcucugcuuguucgugugugugucguugcaggccuuauucaagcuuaccaugggcaagggggaccccaaaaagccuagaggaaaaaugagcuccuacgccuucuuugugcagaccugcagggaggaacacaagaaaaagcauccagaugcuucugucaacuucucagaguuuaguaagaaauguagcgaacgguggaagacaauguccgcaaaagagaaggguaaauucgaagacauggccaaggcggauaaggcucgcuaugagcgagagaugaaaacuuacaucccgcccaagggcgaaacgaaaaagaaauuuaaggacccuaaugccccaaaacgucccccuucugcauucuuucuguucugcucggaguauagaccaaagauuaagggggaacaccccggacucucaauaggcgauguugccaagaaacuuggugagauguggaacaauaccgcugcagacgauaaacaaccuuacgagaagaaagccgcuaagcugaaggaaaaauaugagaaggacaucgccgcguacagggcaaaagggaagccagaugccgcuaaaaagggagugguaaaggccgagaaaagcaagaaaaagaaagaagaagaggaggacgaagaggaugaagaggacgaagaggaggaagaggaugaagaggacgaagacgaggaggaagaugacgaugacgagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5495 - RNA, 921 nt, Artificial Sequence
  mRNA product Design5 comprising derived and/or modified sequence from Mus musculus__NP_001273985.1__MmVEGFA (opt3)
gggagagucccgcagucggcguccagcggcucugcuuguucgugugugugucguugcaggccuuauucaagcuuaccaugaacuuccugcucagcugggugcacuggacccuugcccuguuguuauaccugcaucacgcuaaguggucccaggcagcccccacaacugagggcgaacaaaaaucucaugaggucaucaaguuuauggacguuuaucagagaucauacugcaggccuauugaaacgcuaguggauauauuccaggaguauccagacgaaaucgaguacauuuuuaaaccgaguuguguaccccucaugcggugcgcgggguguugcaaugaugaggcucuggaaugugugccuaccagcgaguccaacaucacaaugcagauuaugcgcaucaagccacaccaaucucagcauauaggagaaaugucguuccuucagcacucacgaugcgagugucgucccaaaaaggacagaacuaagccugagaaaaagagcgucagggguaaaggcaaggggcagaaacggaagcgcaagaaaaguagauuuaaguccuggucugugcacugcgaaccauguagcgagaggcggaaacaucuguucguucaagauccccagaccugcaaguguuccugcaaaaauacagacucacgcugcaaggcccgacaguuggaacucaacgagagaaccuguaggugcgauaaaccucggcguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5496 - RNA, 906 nt, Artificial Sequence
  mRNA product Design5 comprising derived and/or modified sequence from Homo sapiens__NP_061986.1__HsFGF21(L126R,P199G,A208E) (opt4)
gggagagucccgcagucggcguccagcggcucugcuuguucgugugugugucguugcaggccuuauucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagagacugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggcggcagccagggcagaagccccagcuacgagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5497 - RNA, 2463 nt, Artificial Sequence
  mRNA product Design5 comprising derived and/or modified sequence from Mus musculus__NP_001276387.1__MmHGF (opt4)
gggagagucccgcagucggcguccagcggcucugcuuguucgugugugugucguugcaggccuuauucaagcuuaccaugauguggggcaccaagcugcugcccgugcugcugcugcagcacgugcugcugcaccugcugcugcugcacguggccauccccuacgccgagggccagaagaagagaagaaacacccugcacgaguucaagaagagcgccaagaccacccugaccaaggaggacccccugcugaagaucaagaccaagaaggugaacagcgccgacgagugcgccaacagaugcaucagaaacagaggcuucaccuucaccugcaaggccuucguguucgacaagagcagaaagagaugcuacugguaccccuucaacagcaugagcagcggcgugaagaagggcuucggccacgaguucgaccuguacgagaacaaggacuacaucagaaacugcaucaucggcaagggcggcagcuacaagggcaccgugagcaucaccaagagcggcaucaagugccagcccuggaacagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccccauggaccacaccgagagcggcaagaccugccagagaugggaccagcagaccccccacagacacaaguuccugcccgagagauaccccgacaagggcuucgacgacaacuacugcagaaaccccgacggcaagcccagacccuggugcuacacccuggaccccgacacccccugggaguacugcgccaucaagaccugcgcccacagcgccgugaacgagaccgacgugcccauggagaccaccgagugcauccagggccagggcgagggcuacagaggcaccagcaacaccaucuggaacggcauccccugccagagaugggacagccaguacccccacaagcacgacaucacccccgagaacuucaagugcaaggaccugagagagaacuacugcagaaaccccgacggcgccgagagccccuggugcuucaccaccgaccccaacaucagagugggcuacugcagccagauccccaagugcgacgugagcagcggccaggacugcuacagaggcaacggcaagaacuacaugggcaaccugagcaagaccagaagcggccugaccugcagcaugugggacaagaacauggaggaccugcacagacacaucuucugggagcccgacgccagcaagcugaacaagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccacccagaccaccgugggcuggauggugagccugaaguacagaaacaagcacaucugcggcggcagccugaucaaggagagcugggugcugaccgccagacagugcuuccccgccagaaacaaggaccugaaggacuacgaggccuggcugggcauccacgacgugcacgagagaggcgaggagaagagaaagcagauccugaacaucagccagcugguguacggccccgagggcagcgaccuggugcugcugaagcuggccagacccgccauccuggacaacuucgugagcaccaucgaccugcccagcuacggcugcaccauccccgagaagaccaccugcagcaucuacggcuggggcuacaccggccugaucaacgccgacggccugcugagaguggcccaccuguacaucaugggcaacgagaagugcagccagcaccaccagggcaaggugacccugaacgagagcgagcugugcgccggcgccgagaagaucggcagcggccccugcgagggcgacuacggcggcccccugaucugcgagcagcacaagaugagaauggugcugggcgugaucgugcccggcagaggcugcgccauccccaacagacccggcaucuucgugagaguggccuacuacgccaaguggauccacaaggugauccugaccuacaagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5498 - RNA, 924 nt, Artificial Sequence
  mRNA product Design5 comprising derived and/or modified sequence from Homo sapiens__NP_002119.1__HsHMGB1 (opt4)
gggagagucccgcagucggcguccagcggcucugcuuguucgugugugugucguugcaggccuuauucaagcuuaccaugggcaagggcgaccccaagaagcccagaggcaagaugagcagcuacgccuucuucgugcagaccugcagagaggagcacaagaagaagcaccccgacgccagcgugaacuucagcgaguucagcaagaagugcagcgagagauggaagaccaugagcgccaaggagaagggcaaguucgaggacauggccaaggccgacaaggccagauacgagagagagaugaagaccuacaucccccccaagggcgagaccaagaagaaguucaaggaccccaacgcccccaagagaccccccagcgccuucuuccuguucugcagcgaguacagacccaagaucaagggcgagcaccccggccugagcaucggcgacguggccaagaagcugggcgagauguggaacaacaccgccgccgacgacaagcagcccuacgagaagaaggccgccaagcugaaggagaaguacgagaaggacaucgccgccuacagagccaagggcaagcccgacgccgccaagaagggcguggugaaggccgagaagagcaagaagaagaaggaggaggaggaggacgaggaggacgaggaggacgaggaggaggaggaggacgaggaggacgaggacgaggaggaggacgacgacgacgagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5499 - RNA, 921 nt, Artificial Sequence
  mRNA product Design5 comprising derived and/or modified sequence from Mus musculus__NP_001273985.1__MmVEGFA (opt4)
gggagagucccgcagucggcguccagcggcucugcuuguucgugugugugucguugcaggccuuauucaagcuuaccaugaacuuccugcugagcugggugcacuggacccuggcccugcugcuguaccugcaccacgccaaguggagccaggccgcccccaccaccgagggcgagcagaagagccacgaggugaucaaguucauggacguguaccagagaagcuacugcagacccaucgagacccugguggacaucuuccaggaguaccccgacgagaucgaguacaucuucaagcccagcugcgugccccugaugagaugcgccggcugcugcaacgacgaggcccuggagugcgugcccaccagcgagagcaacaucaccaugcagaucaugagaaucaagccccaccagagccagcacaucggcgagaugagcuuccugcagcacagcagaugcgagugcagacccaagaaggacagaaccaagcccgagaagaagagcgugagaggcaagggcaagggccagaagagaaagagaaagaagagcagauucaagagcuggagcgugcacugcgagcccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5500 - RNA, 906 nt, Artificial Sequence
  mRNA product Design5 comprising derived and/or modified sequence from Homo sapiens__NP_061986.1__HsFGF21(L126R,P199G,A208E) (opt5)
gggagagucccgcagucggcguccagcggcucugcuuguucgugugugugucguugcaggccuuauucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagagacugcuugaagauggcuauaacguguaccaguccgaggcccacgggcugccccuccaucugccuggaaauaaaagcccgcaccgggaccccgcgccucgcggccccgccagauuucugccucuccccgggcugccgccugcccuucccgaaccucccggaauccuggcuccccagccuccggauguugggucuuccgacccccucagcauggugggcgggucucagggacgguccccuagcuaugagucuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5501 - RNA, 2463 nt, Artificial Sequence
  mRNA product Design5 comprising derived and/or modified sequence from Mus musculus__NP_001276387.1__MmHGF (opt5)
gggagagucccgcagucggcguccagcggcucugcuuguucgugugugugucguugcaggccuuauucaagcuuaccaugauguggggcaccaagcugcuccccgugcugcuucugcagcacguccuccugcaucuucugcuccugcacguugccaucccuuacgcugaggggcagaaaaagagacggaacacacugcaugaguucaaaaagagcgccaaaacgacccucacaaaggaagacccgcugcuuaagauuaaaaccaagaaagucaauuccgcggaugaaugcgcuaaccgcuguaucagaaaucggggauuuacauuuaccugcaaggccuucguguucgacaaaucucgcaagagauguuauugguaccccuuuaacagcauguccucuggcgugaagaaaggguucggacacgaguuugaucuguaugaaaauaaggacuacauucggaacugcaucauuggcaaagggggaagcuauaagggcacaguguccaucaccaaaucuggcaucaagugucaaccuuggaauagcaugauuccccaugagcacuccuuccucccuagcucuuaccgcgggaaagaucugcaggagaacuauugcagaaauccccggggagaagagggcgggccuugguguuuuacguccaacccggaaguucgcuacgaggugugcgacaucccccaguguagcgaggucgaaugcaugaccuguaauggagagucuuacagaggcccuauggaucacacagaauccgggaagaccugccaacggugggaccagcagacaccccaucgccacaaguuccuuccugagagauaucccgauaaaggauuugacgauaacuacugccggaauccggacggcaagccucgccccugguguuauacccuggauccugacacgcccugggaauacugcgccauuaaaacaugugcucauagcgccgugaacgagaccgacguucccauggagacaaccgaaugcauccagggccaaggggagggauauagaggcaccucuaauacaauuuggaacgggaucccuugucagcggugggauucccaguacccgcacaagcacgacauuacgcccgaaaacuucaaaugcaaggaucucagagagaauuauugucgcaacccugacggagcugaaagccccuggugcuuuaccacagauccuaauauccgggugggcuacuguucccagauccccaagugcgacgucucuagcgggcaagauuguuacagaggaaacggcaaaaauuauaugggcaaccuguccaagacccgcagcgggcugacaugcucuaugugggacaaaaauauggaggaucuccaucggcacauuuucugggagccggacgccuccaagcugaacaaaaauuacugcagaaacccugaugacgacgcgcauggacccugguguuauaccggcaauccucuuauccccugggauuacugcccuauuagccgcugugaaggggacacgacacccaccaucgugaaccuggaucacccggugauuucuugcgccaagaccaagcagcuccgggucguuaauggaaucccuacacagaccacagugggcuggauggugagccugaaauauagaaacaagcauaucugugggggcucccuuauuaaagagucuuggguccugacggcucgccaaugcuuccccgcccggaauaaggaccucaaagauuacgaggcuuggcugggaauccacgacgugcacgaaagaggcgaagagaagcgcaagcagauucugaacaucagccagcucguuuaugggcccgagggauccgaucuggugcuucugaaacucgcccggccugcgauucuggacaacuuugucagcaccaucgaucuuccgucuuacggcuguacaauccccgaaaagaccacaugcuccauuuacggguggggauauaccggccugaucaaugccgacgggcuccugagaguggcucaucuguacauuaugggcaacgagaaauguagccagcaccaucaaggaaagguuacgcucaaugaaucugagcugugcgccggcgcugagaaaaucggguccggaccuugugaaggcgauuaugggggaccccuuauuugcgagcagcacaagaugcggauggugcugggcgucaucgugccugggcgcggcugcgccauucccaacagaccuggaaucuucguccggguggccuacuaugcuaaauggauccacaagguuauucucaccuacaagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5502 - RNA, 924 nt, Artificial Sequence
  mRNA product Design5 comprising derived and/or modified sequence from Homo sapiens__NP_002119.1__HsHMGB1 (opt5)
gggagagucccgcagucggcguccagcggcucugcuuguucgugugugugucguugcaggccuuauucaagcuuaccaugggcaagggggaccccaaaaagccuagaggaaaaaugagcuccuacgccuucuuugugcagaccugccgggaggaacacaagaaaaagcauccggaugcuucugucaacuucagcgaguuuuccaagaaauguucugaacgcuggaagacaaugagcgccaaagagaagggcaaauucgaagacauggcgaaggcugauaaggccagauaugagcgggagaugaaaacguacauucccccuaagggggaaaccaaaaagaaauuuaaggaccccaaugccccuaaaagacccccuuccgcuuucuuucuguucugcucugaguaucgcccgaagaucaagggagaacaccccggccucagcaucggggauguugccaaaaagcugggagagauguggaacaauacagcugccgacgauaaacaaccuuacgagaagaaagcggccaaacuuaaggaaaaguaugagaaggacauugcugccuaccgggcuaaaggcaagcccgaugccgcgaaaaagggcguggugaaggccgaaaaauccaagaaaaagaaagaggaagaggaggacgaagaggaugaagaggacgaagaggaggaagaggaugaagaggacgaagacgaggaggaagaugacgaugacgagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5503 - RNA, 921 nt, Artificial Sequence
  mRNA product Design5 comprising derived and/or modified sequence from Mus musculus__NP_001273985.1__MmVEGFA (opt5)
gggagagucccgcagucggcguccagcggcucugcuuguucgugugugugucguugcaggccuuauucaagcuuaccaugaacuuccugcucagcugggugcacuggacccuggcccuucugcucuaccugcaucacgcuaaguggucccaggccgcgcccacaacggagggcgaacaaaaaucucaugaggucaucaaguuuauggacguuuaucagagaagcuacugccggccuauugaaacccuuguggauaucuuccaggaguauccggacgaaauugaguacaucuuuaaacccuccugugugccucugaugcgcugcgcuggguguugcaaugaugaggcccucgaauguguccccacaucugagagcaacauuaccaugcagaucaugagaaucaagccucaccaaucccagcauauuggagaaaugucuuuccugcagcacagccggugcgagugucgccccaaaaaggacagaacaaagccugagaaaaaguccgugcggggcaaagggaagggacagaaacgcaagagaaagaaaagccgguuuaagucuugguccguucacugcgaaccguguagcgagcgcagaaaacaucuguucgugcaagauccccagaccugcaaguguucuugcaaaaauacagacucccggugcaaggcccgccagcucgaacugaacgagagaaccugucggugcgauaaaccucgcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5504 - RNA, 906 nt, Artificial Sequence
  mRNA product Design5 comprising derived and/or modified sequence from Homo sapiens__NP_061986.1__HsFGF21(L126R,P199G,A208E) (opt6)
gggagagucccgcagucggcguccagcggcucugcuuguucgugugugugucguugcaggccuuauucaagcuuaccauggauucagaugaaacaggauuugaacacucaggauuaugggucucaguuuuagcaggacuauuacuaggagcaugucaagcacauccaauaccagacucaagcccauuauuacaauuuggaggacaaguaagacaaagauauuuauauacagaugacgcacaacaaacagaagcacauuuagaaauaagagaagacggcacaguaggaggagcagcagaucaaucaccagaaucacuauuacaauuaaaagcauuaaaaccaggaguaauacaaauauuaggaguaaaaacaucaagauucuuaugccaaagaccugacggagcauuauaugguucacuacacuuugacccagaagcauguucauucagagaaagacuacuagaagacggauauaauguuuaccaaucugaagcacauggauuaccacuacacuuaccaggaaauaaaucaccacaccgagacccagcaccacgaggaccagcaagauuccuaccacuaccaggauuaccaccagcauuaccagaaccaccaggaauacuagcuccacaaccaccagacguaggauccucagauccauuaucaaugguaggaggaucucaagguagaagucccucauacgaaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5505 - RNA, 2463 nt, Artificial Sequence
  mRNA product Design5 comprising derived and/or modified sequence from Mus musculus__NP_001276387.1__MmHGF (opt6)
gggagagucccgcagucggcguccagcggcucugcuuguucgugugugugucguugcaggccuuauucaagcuuaccaugauguggggaacaaaacuauuaccaguauuauuauuacaacaugucuuauuacauuuacuucuacuacauguugcaauacccuaugccgaaggacaaaagaaaagaagaaacacucuucacgaguucaagaaaagcgcaaaaacaacauuaacaaaagaagacccacuacuaaaaauaaaaacaaagaaaguaaacucagcagaugaaugugccaacagauguauuagaaaccgggguuuuacuuuuacaugcaaagccuucguauucgauaaaucaaggaaaagaugcuacugguauccauucaauucaaugucauccggagucaagaaaggauucggccaugaauuugaccuauacgaaaauaaagauuauaucagaaacuguauaauaggaaaaggugguucauacaaaggaacaguaucaauaacaaaaagcgguauuaaaugucaacccuggaacucuaugauuccucaugaacauucauuuuuaccaucaucauacagagguaaagacuuacaagaaaauuacugcagaaauccaaggggagaagaaggcggaccauggugcuuuacaucaaaucccgaaguaagauaugaaguaugcgacauaccacaauguagugaaguugaauguaugacauguaauggagaaagcuacagagguccaauggaucauacagaaucaggaaaaacaugccaaagaugggaucaacaaacaccgcauagacauaaauuuuuaccagaaagauauccagauaaaggauucgaugacaauuacuguaggaaucccgacggaaaaccacgaccauggugcuauacacuagacccugauacuccaugggaauauugcgcuauaaaaacuugugcacauucagcaguaaacgaaaccgacguaccaauggaaaccacugaauguauacaagggcaaggagaaggauacagaggaacaucaaauacaauauggaacggaauacccugucaaagaugggauagccaauauccacauaaacacgacauaaccccagaaaacuuuaaauguaaagaucuaagagaaaauuacugcagaaaucccgauggcgcagaaucaccauggugcuucacaacagaucccaacauaagagucggauauugcucccagauuccuaaaugugauguaagcuccgggcaagacugcuaccgaggcaacgguaaaaauuacaugggaaacuuaaguaaaacaagaucaggauuaacaugcaguaugugggauaaaaauauggaggacuuacauagacauauauucugggaaccagaugcaucaaaacuuaacaaaaauuauugcagaaacccagacgacgaugcacacggaccaugguguuauacaggaaauccacuuauaccaugggacuauuguccaauaucacgaugcgaaggagauacaacaccaacaauaguaaacuuagaucauccaguaauaaguugcgcaaaaacuaaacaauuacgaguuguuaacggaauaccaacacaaacuacagucggauggaugguuucauuaaaauauagaaacaaacacauaugcggaggaucccuuauaaaagaauccuggguauuaacagcaagacaauguuuuccagccagaaauaaagaucucaaagacuacgaagcaugguuaggcauacacgauguacaugaacgaggagaagaaaaacgaaaacaaauauuaaauauaagccagcuaguuuauggaccagaaggaucggacuuaguacuauuaaaacuugcaagaccagcaauccuagacaauuuugucucaacaaucgacuuacccucauauggaugcacuauuccggagaaaacaacaugcuccauauacggauggggauauacaggauugauaaaugcagauggauuacuaagaguagcacaucuauacauaaugggaaaugaaaaauguucacaacaccaucaaggaaaaguaacacuaaacgaaagcgaauuaugugcaggcgcagagaaaauaggcaguggaccaugugaaggagauuacgguggaccacuaauaugcgaacaacauaaaaugagaaugguccuaggaguaauaguccccggaagaggaugugcaauaccaaaucgaccgggcauauuuguaagaguagcauacuacgcaaaauggauacacaaaguaauacuaacauacaaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5506 - RNA, 924 nt, Artificial Sequence
  mRNA product Design5 comprising derived and/or modified sequence from Homo sapiens__NP_002119.1__HsHMGB1 (opt6)
gggagagucccgcagucggcguccagcggcucugcuuguucgugugugugucguugcaggccuuauucaagcuuaccaugggaaaaggagacccaaaaaaaccaagaggaaaaaugucaagcuacgcauucuucguacaaacaugcagagaagaacacaaaaaaaaacacccagacgcaagcguaaacuucagcgaauucagcaaaaaauguucagaaagauggaaaacaaugagcgcaaaagaaaaaggaaaauucgaagacauggcaaaagcagacaaagcaagauacgaaagagaaaugaaaacauacauaccaccaaaaggagaaacaaaaaaaaaauucaaagacccaaacgcgccaaaaagaccaccaucagcauucuucuuauucugcagugaauacagaccaaaaauaaaaggagaacacccaggacuaaguauaggagacguagcaaaaaaacuaggagaaauguggaacaacacagcagcagacgacaaacaaccauacgaaaaaaaagcagcaaaacuaaaagaaaaauacgaaaaagacauagcggcauacagagcaaaaggaaaaccagacgcagcaaaaaaaggaguaguaaaagcagaaaaaaguaaaaaaaaaaaagaagaagaagaagacgaagaagacgaagaagacgaagaagaagaagaagacgaagaagacgaagacgaagaagaagacgacgacgacgaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5507 - RNA, 921 nt, Artificial Sequence
  mRNA product Design5 comprising derived and/or modified sequence from Mus musculus__NP_001273985.1__MmVEGFA (opt6)
gggagagucccgcagucggcguccagcggcucugcuuguucgugugugugucguugcaggccuuauucaagcuuaccaugaacuuccuauuaagcuggguacacuggacacuagcacuacuacuauacuuacaccacgccaaauggagccaagcagcaccaacaacagaaggagaacaaaaaucacacgaaguaauaaaauucauggacguauaccaaagaucauacuguagaccaauagaaacacuaguagacauauuccaagaauacccagacgaaauagaauacauauucaaaccaucaugcguaccacuaaugagaugcgcaggaugcugcaacgacgaagcacuagaaugcguaccaacaucagaaucaaacauaacaaugcaaauaaugagaauaaaaccacaccaaagucaacacauaggagaaaugaguuuccuacaacacucaagaugcgaaugcagaccaaaaaaagacagaacaaaaccagaaaaaaaaucaguaagaggaaaaggaaaaggccaaaaaagaaaaagaaaaaaaucaagauucaaaagcuggucaguacacugugaaccauguucagaaagaagaaaacaccuauucguacaagacccacaaacaugcaaaugcaguugcaaaaacacagacucaagaugcaaagcaagacaacuagaauuaaaugaacgaacaugcagaugcgacaaaccaagaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5508 - RNA, 906 nt, Artificial Sequence
  mRNA product Design5 comprising derived and/or modified sequence from Homo sapiens__NP_061986.1__HsFGF21(L126R,P199G,A208E) (opt7)
gggagagucccgcagucggcguccagcggcucugcuuguucgugugugugucguugcaggccuuauucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagaggcugcuggaagauggguauaacguguaccagagugaggcccacggcuugccccuccaucugccagguaauaaaagcccgcaccgggaccccgcaccacgcgggcccgccagguuucugccacuccccggccugccgcccgccuugccagaacccccaggcauccuggcaccccagccaccggaugugggguccagcgacccccucaguauggucgguggcucccaggggcggagcccauccuaugagaguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5509 - RNA, 2463 nt, Artificial Sequence
  mRNA product Design5 comprising derived and/or modified sequence from Mus musculus__NP_001276387.1__MmHGF (opt7)
gggagagucccgcagucggcguccagcggcucugcuuguucgugugugugucguugcaggccuuauucaagcuuaccaugauguggggcaccaagcugcuccccgugcuguugcugcagcacguccuccugcauuugcugcuccugcacguggccaucccauacgcagaggggcagaaaaagaggcggaacacucugcaugaguucaaaaagagcgccaaaaccacgcucacuaaggaggacccgcuguugaagauuaaaaccaagaaaguaaauuccgcggaugaaugcgccaaccgcuguaucaggaaucgggguuuuaccuucacuugcaaggcauuuguguucgacaaaagucgcaagagguguuauugguaccccuuuaacagcauguccaguggcgucaaaaagggguucggccacgaguuugaucuguaugaaaauaaggacuacauucggaacugcaucauugguaaagggggcagcuauaagggcaccguguccaucacgaaaagcgggaucaagugucaaccauggaacuccaugauuccccaugagcacaguuuccucccaagcuccuaccgcgguaaagaucugcaggagaauuauugcaggaauccccggggcgaagaagggggcccaugguguuuuacuagcaacccggaagugcgcuacgaggucugcgacaucccccaguguagugagguggaaugcaugaccugcaauggugaguccuacagggggccaauggaucacacugaaagcggcaagaccugucaacggugggaccagcagacuccccaucgccacaaguuccugccagagagguaucccgauaaaggcuuugacgauaacuacugccggaauccggacgggaagccccgcccaugguguuauacguuggaucccgacacuccaugggaauacugcgccauuaaaaccugugcacauuccgccguaaacgagacugacgugcccauggagaccaccgaaugcauccagggucaaggcgagggguauaggggcaccaguaauacgauuuggaacgguaucccaugucagcggugggauagccaguacccgcacaagcacgacauuacccccgaaaacuucaaaugcaaggaucuccgcgagaauuauuguaggaacccagacggcgcggaaucccccuggugcuucacuaccgauccaaauauccgggucggguacugcagccagauccccaagugugacgugaguuccggccaagauugcuacagggggaacgguaaaaauuauaugggcaaccugagcaagacccgcagugggcugacuuguuccaugugggacaaaaauauggaggaucuccaucggcacaucuuuugggagccggacgccagcaagcugaacaaaaauuacugcaggaacccagaugacgacgcacauggccccugguguuauacggguaaucccuugauuccaugggauuacugccccauuagccgcugugaaggcgacaccacuccaaccaucgugaaccuggaucacccggucauuuccugcgccaagaccaagcagcuccgggugguaaaugggauccccacucagacgaccgugggcuggauggucagucugaaauauaggaacaagcauaucugugggggcagccugauuaaagaguccuggguguugacugcccgccaaugcuucccagcacggaauaaggaccucaaagauuacgaagccuggcuggguauccacgacgugcacgagaggggcgaagagaagcggaaacagauucugaacaucagccagcucgucuaugggcccgaggguagugaucugguguugcugaagcucgcgcgcccagccauucuggacaacuuuguauccaccaucgaucugcccagcuacggcuguacuaucccggaaaagaccacgugcuccauuuacggguggggcuauaccggguugaucaaugcagacggccuccugaggguggcccaucuguacauuauggguaacgagaaaugcagucagcaccaucaagggaaggucacucucaaugaaagcgagcugugugcaggcgccgagaaaaucggcuccgggccaugcgaaggugauuauggcgggcccuugauuugugagcagcacaagaugcggauggugcugggcgucaucgugccaggucgcgggugcgccauucccaacaggccgggcaucuucgugcggguagcguacuaugcaaaauggauccacaaggugauucucaccuacaagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5510 - RNA, 924 nt, Artificial Sequence
  mRNA product Design5 comprising derived and/or modified sequence from Homo sapiens__NP_002119.1__HsHMGB1 (opt7)
gggagagucccgcagucggcguccagcggcucugcuuguucgugugugugucguugcaggccuuauucaagcuuaccaugggcaagggggaccccaaaaagccaagggguaaaaugagcuccuacgccuucuuugugcagaccugccgggaggaacacaagaaaaagcauccggaugcaagugucaacuucagcgaguuuuccaagaaauguagugaacgcuggaagacuaugagcgccaaagagaagggcaaauucgaagacauggcgaaggccgauaaagcaagguaugagcgggagaugaagaccuacauucccccaaagggggaaacgaaaaagaaauuuaaggaccccaaugccccaaaaaggcccccauccgcauucuuucuguucugcagcgaguaucgcccgaagaucaagggcgaacaccccggucucuccaucggggauguggccaaaaagcugggcgagauguggaacaauacugcggccgacgauaaacaaccauacgagaagaaagcagccaaguugaaggaaaaauaugagaaggacauugccgcauaccgggccaaaggcaagcccgaugcggccaaaaaggggguagugaaggcagagaaaaguaagaaaaagaaagaagaagaggaggacgaagaggaugaagaggacgaagaggaggaagaggaugaagaggacgaagacgaggaggaagaugacgaugacgagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5511 - RNA, 921 nt, Artificial Sequence
  mRNA product Design5 comprising derived and/or modified sequence from Mus musculus__NP_001273985.1__MmVEGFA (opt7)
gggagagucccgcagucggcguccagcggcucugcuuguucgugugugugucguugcaggccuuauucaagcuuaccaugaacuuccugcucagcugggugcacuggacccuggccuugcugcucuaccugcaucacgcaaaguggucccaggccgcgcccacuaccgagggcgaacagaaaagucaugaggucaucaaguuuauggacguguaucaaaggagcuacugccggccaauugaaacguugguagauaucuuccaggaguauccggacgaaauugaguacaucuuuaaacccuccugugugccacugaugcgcugcgccggguguugcaaugaugaggcacucgaauguguccccaccagugagagcaacauuacuaugcagaucaugaggaucaagccacaccaaucccagcauauuggugaaaugagcuuccugcagcacucccggugcgagugucgccccaaaaaggacaggaccaagccagagaaaaagagugugcggggcaaagggaagggccagaaacgcaagaggaaaaagagccgguuuaaguccuggagcgugcacugcgaaccguguagugagcgcaggaaacaucuguucguccaagauccccagacuugcaagugcuccuguaaaaauaccgacagccggugcaaggcccgccagcucgaacugaacgagaggacgugucggugcgauaaaccaaggcgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5512 - RNA, 906 nt, Artificial Sequence
  mRNA product Design5 comprising derived and/or modified sequence from Homo sapiens__NP_061986.1__HsFGF21(L126R,P199G,A208E) (opt8)
gggagagucccgcagucggcguccagcggcucugcuuguucgugugugugucguugcaggccuuauucaagcuuaccauggacucugacgaaaccggcuucgaacacuccggacucugggucuccguccucgccggccuccuccuaggcgccugccaagcccaccccauccccgacucauccccacuccuacaauucggcggccaaguccgucaacgcuaccucuauaccgaugacgcccaacaaaccgaagcccaccucgaaauccgcgaagacggaaccgucggcggcgccgcugaccaaucacccgaaucccuccuccaacucaaagcacucaaacccggcguaauccaaauccucggcguaaaaaccucacgauuucuaugucaaagacccgacggagcccuauacggcucucuacacuucgacccagaagcaugcuccuuccgcgaacgacuccucgaagacggauacaacgucuaccaaucagaagcccacggccuaccccuccaccuccccggcaacaaaucuccccaccgcgaccccgcaccccgcggccccgcccgcuuccucccccuccccggccuacccccagcccuacccgaaccacccggcauacucgcaccccaaccacccgacgucggcuccuccgacccccuauccauggucggcggcucccaaggccgcucccccucauacgaaucuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5513 - RNA, 2269 nt, Artificial Sequence
  mRNA product Design5 comprising derived and/or modified sequence from Mus musculus__NP_001276387.1__MmHGF (opt8)
gggagagucccgcagucggcguccagcggcucugcuuguucgugugugugucguugcaggccuuauucaagcuuaccaugauguggggcacgaaacugcucccaguauugcucuugcaacacguccuacuccaccuucuacugcuacacgucgcuauacccuaugccgaaggacaaaagaaacgucgcaacacccuacacgaauuuaagaaaagcgccaagaccacacucacuaaagaagauccccuacucaaaauaaagaccaaaaaggugaacucggcugacgaaugcgccaaccgaugcauccgaaacagaggcuucacuuuuaccugcaaagccuucguuuucgacaagagccgaaaacgaugcuacugguacccauucaacagcauguccuccgggguaaagaaaggcuucggacaugaguucgaucuauacgaaaauaaagacuacauaagaaacugcauaaucggcaaaggaggguccuacaaaggcacagucagcaucacaaagucagggaucaaaugccaacccuggaacuccaugauaccacacgagcacaguuuccucccuaguagcuaccgaggaaaagaccuccaggagaacuacugccgcaacccccgcggggaagaaggcggaccuuggugcuucacaagcaaccccgagguccgcuacgaggucugcgacaucccccaaugcagcgaagucgagugcaugaccuguaacggagaaucauaccgaggcccaauggaucacaccgaauccggaaaaacaugccaacgaugggaccaacaaacaccgcaccgacacaaguuccuccccgaacgguaccccgacaaaggauucgacgacaacuacugccgcaaccccgacggaaaaccacgaccauggugcuacacgcucgacccggacacccccugggaauacugcgccaucaaaaccugcgcacacucagcggugaacgaaaccgauguaccaauggaaacaaccgaaugcauccaaggacaaggagagggcuacaggggcacgucaaauaccaucuggaacggcauaccaugccagcgcugggacagucaguacccccacaaacacgacauaacccccgaaaacuucaaaugcaaagaccucagagaaaacuacugccgcaaccccgacggcgccgaaucccccugguguuucacaaccgacccaaacauccgcgugggcuacugcucacaaauccccaagugcgacguaucaagcggccaagacugcuaucgcgggaacggcaaaaacuacaugggaaaccucucaaagaccagaagcggccuaacaugcucaaugugggacaaaaacauggaggaccuccaccggcacaucuuuugggaacccgacgcuuccaaacucaacaaaaacuacugccgaaaccccgacgacgaugcacacggcccauggugcuacacaggcaacccccugauacccugggacuacugccccaucuccagaugcgagggcgacacaacaccgaccaucguaaaucucgaccaccccguaaucuccugcgccaaaacaaaacaacuaagggucgugaacggaauccccacccaaacaacagugggcuggauggucagccucaaauacagaaacaagcacaucugcggcggcucccucaucaaggaaagcuggguacuaacagccaggcaaugcuuccccgccagaaauaaagaucuaaaagacuacgaagccuggcuaggcauccaugacguccacgaacgcggcgaggagaaacgaaaacaaauucucaacaucucucaacucgucuauggaccagaagggagcgaccucguucuucugaaacucgcccggcccgcaaucuuagacaacuucgucagcacaaucgaccuccccucauacggaugcaccaucccagaaaagacaaccugcagcauauacggauggggcuacaccggccugaucaacgcagacggccuucucagagucgcccaucucuacaucaugggaaacgaaaaaugcagccaacaccaccaaggcaaaguaacgcucaacgaauccgaacucugcgccggagcagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5514 - RNA, 924 nt, Artificial Sequence
  mRNA product Design5 comprising derived and/or modified sequence from Homo sapiens__NP_002119.1__HsHMGB1 (opt8)
gggagagucccgcagucggcguccagcggcucugcuuguucgugugugugucguugcaggccuuauucaagcuuaccauggggaaaggggacccgaaaaagccaagaggaaagaugucgagcuaugccuuuuucgugcaaacgugcagggaagaacacaagaaaaagcacccggacgcgagcgugaacuuuagcgaguucucgaaaaagugcucagaaagguggaagaccaugagcgcgaaagaaaaagggaaauuugaagauauggcaaaagcggacaaggcaagguacgagcgagaaaugaagacauauaucccgccaaagggcgagacaaagaagaaauucaaagacccgaacgcgcccaagcgcccgccaucggccuuuuuccuauucugcagcgaguacaggcccaagauaaagggcgagcacccaggauugagcauaggcgaugucgcgaaaaagcuaggggaaauguggaacaacacggccgcggacgauaaacagccguaugaaaagaaagcggccaagcucaaggaaaaguacgagaaagauaucgcggccuauagagcgaaaggaaaaccggacgcggccaagaaagggguagugaaagcggaaaagagcaagaaaaagaaagaggaagaggaagaugaagaggacgaggaagacgaagaggaagaggaagaugaagaggacgaggacgaggaagaggacgaugacgaugaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5515 - RNA, 921 nt, Artificial Sequence
  mRNA product Design5 comprising derived and/or modified sequence from Mus musculus__NP_001273985.1__MmVEGFA (opt8)
gggagagucccgcagucggcguccagcggcucugcuuguucgugugugugucguugcaggccuuauucaagcuuaccaugaacuuccuccucuccuggguccacuggacccucgcccuccuccucuaccuucaccacgcaaaauggucccaagccgcccccaccaccgaaggagaacaaaaaucccacgaagucauaaaauucauggacguauaccaacgaucauacugccgacccaucgaaacccuagucgacaucuuccaagaauacccagacgaaaucgaauacauauucaaacccuccugcguaccccucaugcgcugcgccggcugcugcaacgacgaagcccuagaaugcgucccaacaucagaaucaaacaucaccaugcaaaucaugcgcaucaaaccacaccaaucccaacacauaggcgaaauguccuuccuccaacacucacgcugcgaaugccgccccaaaaaagaccgaaccaaacccgaaaaaaaaucaguccgaggcaaaggaaaaggccaaaaacgcaagcgcaaaaaaucccgcuucaaauccugguccguccacugcgaacccugcuccgaacgccgaaaacaccucuucguccaagacccacaaaccugcaaaugcuccugcaaaaacaccgacuccagaugcaaagcacgccaacucgaacucaacgaaagaaccugccgcugcgacaaaccccgccgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5516 - RNA, 906 nt, Artificial Sequence
  mRNA product Design5 comprising derived and/or modified sequence from Homo sapiens__NP_061986.1__HsFGF21(L126R,P199G,A208E) (opt9)
gggagagucccgcagucggcguccagcggcucugcuuguucgugugugugucguugcaggccuuauucaagcuuaccauggacuccgacgaaaccggauucgaacacucaggccucugggucucaguccucgccggccuccuccucggagccugccaagcccacccaauccccgacuccucaccacuccuccaauucggcggccaaguccgacaacgauaccucuacaccgacgacgcccaacaaaccgaagcccaccucgaaauccgcgaagacggcacaguaggaggcgccgccgaccaaucacccgaaucccuacuccaacuaaaagcacucaaacccggcgucauccaaauacucggcgucaaaaccucaagauuccucugccaacgccccgacggcgcccucuacggcucccuccacuucgaccccgaagccugcuccuuccgcgaacgccuccucgaagacggcuacaacgucuaccaauccgaagcccacggccucccccuccaccucccaggcaacaaauccccacaccgcgaccccgcaccccgcggcccagcccgcuuccucccccuccccggacuacccccugcccuacccgaaccaccaggcauccucgcaccccaaccacccgacgucggcuccuccgacccccucucaaugguaggcggcucacaaggccgaucccccuccuacgaauccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5517 - RNA, 2463 nt, Artificial Sequence
  mRNA product Design5 comprising derived and/or modified sequence from Mus musculus__NP_001276387.1__MmHGF (opt9)
gggagagucccgcagucggcguccagcggcucugcuuguucgugugugugucguugcaggccuuauucaagcuuaccaugauguggggcacaaaacuccuuccgguacugcugcuacaacacgugcuucuccaccuccuucuacuccacgucgcaauccccuaugcagaagggcagaaaaagcgacgcaacacacuccacgaguucaagaaaucggccaaaacaacccuaaccaaagaggacccccuccucaaaaucaaaaccaagaaaguaaacuccgccgacgagugcgccaacagaugcauccgcaaccggggcuucaccuucacaugcaaagccuucguguucgauaaaagccgcaaacgaugcuacugguacccauucaacuccaugagcucgggaguuaagaaaggcuuuggccacgaauuugaccuauacgagaauaaagacuacauaagaaacugcaucaucgguaaaggcggcucauacaaagggaccguauccaucacaaaaagcggaauaaaaugccaaccguggaacucuaugauaccccacgaacacucauuccuaccauccucauaccgcggcaaagaccuacaagagaacuacugccgaaacccccgaggagaagaagggggaccauggugcuucaccucaaacccagagguacgguacgaagucugcgacaucccacaaugcagcgaaguagagugcaugaccuguaacggagaguccuaccggggaccaauggaccauaccgaaucgggaaaaacuugccaacgaugggaucaacaaacaccccaucgucacaaauuccuaccggaacgauacccagacaaaggauucgacgacaacuacugcagaaaucccgacgguaaacccagaccuuggugcuacacccuagaccccgacaccccaugggaauacugcgccauaaagaccugcgcacacucugccgucaacgagaccgacguccccauggaaacaaccgaaugcauacaggggcagggagagggcuaccgcggcaccagcaacaccaucuggaacgguauacccugccagcgaugggacagccaauacccccacaagcacgacauaaccccugagaacuucaagugcaaagaccuacgcgaaaacuacugccgaaacccagacggcgccgaaucaccaugguguuucacaacagacccaaacauccgcgucggcuacugcucccaaauacccaaaugcgacgucaguuccggacaagacugcuaccgaggcaacggaaagaacuacaugggaaaccucuccaaaacccguagcgguuuaacaugcuccaugugggacaagaacauggaagaccuacacagacauauauucugggaacccgacgcaagcaaacucaacaaaaauuacugccgcaaccccgacgacgaugcccauggccccuggugcuacaccggcaacccccugauccccugggacuacuguccaauaagccgaugcgagggggacaccaccccuaccaucgucaaccuggaccaccccgucaucuccugcgcaaaaaccaaacagcuccgaguagugaacggcaucccaacccagacaacggucggauggauggucucacuaaaauaccgaaacaaacacauaugcgguggaucccucaucaaagaaagcugggucuuaaccgcccgccaaugcuuccccgcacgaaacaaagaccuaaaagacuacgaagcauggcuaggcauccacgacguacacgaacgaggcgaagaaaaacgaaagcaaauccucaacaucucacaguuagucuacggaccagaagguucagaccucgugcuccuaaaguuagcccgccccgccauacuagacaacuucgucagcaccaucgaccuaccaucauacggaugcaccauaccagagaaaaccacaugcaguaucuacggcuggggcuacacgggccucaucaacgccgacggccuccuacgcguagcccaccucuauaucaugggcaacgaaaaaugcucacaacaccaccaagggaaaguaacacugaacgaauccgagcucugcgccggcgccgagaaaaucggauccggccccugcgaaggagacuacgggggaccacuaauaugcgaacagcacaagaugcgaaugguccucggagucaucguacccggccgaggcugcgcaauacccaaucgccccggcauauucguucgcguagccuacuacgcuaaauggauccacaaagucauacucaccuacaaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5518 - RNA, 924 nt, Artificial Sequence
  mRNA product Design5 comprising derived and/or modified sequence from Homo sapiens__NP_002119.1__HsHMGB1 (opt9)
gggagagucccgcagucggcguccagcggcucugcuuguucgugugugugucguugcaggccuuauucaagcuuaccauggggaaaggggacccgaagaaaccaaggggaaaaaugucgagcuaugccuucuucgugcaaacgugcagggaggaacacaagaaaaagcacccagacgcgagcgugaacuuuagcgaguucucgaaaaagugcucggaaagguggaagacaaugagcgcgaaagagaaagggaaauuugaagauauggcgaaagcggacaaggccagguacgagcgagagaugaagaccuauaucccgcccaagggcgagacaaagaagaaauucaaagacccgaacgcgccaaagcgcccgcccucggcauuuuucuuguucuguagcgaguacaggccaaagaucaagggcgagcacccaggcuugagcauaggcgaugucgccaaaaagcucggggaaauguggaauaacacagcagcagacgauaaacagcccuaugaaaagaaagcggcaaagcucaaggaaaaguacgagaaagauaucgcggccuaucgcgcgaaagggaaaccggacgcggcaaagaaaggggucgugaaagcggaaaagagcaagaaaaagaaagaggaagaggaagaugaagaggacgaggaagaugaagaggaagaggaagaugaagaggacgaggacgaagaagaggacgaugacgaugaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5519 - RNA, 921 nt, Artificial Sequence
  mRNA product Design5 comprising derived and/or modified sequence from Mus musculus__NP_001273985.1__MmVEGFA (opt9)
gggagagucccgcagucggcguccagcggcucugcuuguucgugugugugucguugcaggccuuauucaagcuuaccaugaacuuccuccucuccuggguccacuggacacucgcccuccuccuauaccuacaccacgccaaauggagccaagccgcccccacaaccgaaggcgaacaaaaaucccacgaagucaucaaauucauggacgucuaccaacgcuccuacugccgccccaucgaaacccucgucgacaucuuccaagaauaccccgacgaaaucgaauacaucuucaaacccuccugcgucccccucaugcgcugcgccggcugcugcaacgacgaagcccucgaaugcguccccaccucagaaucaaacauaacaaugcaaaucaugcgcaucaaaccccaccaaucccaacacaucggagaaauguccuuccuccaacacucacgcugcgaaugccgcccaaaaaaagaccgcaccaaacccgaaaaaaaauccguacgcggcaaaggcaaaggccaaaaacgcaaacgcaaaaaaucccgcuucaaaucauggucaguccacugcgaacccugcagcgaacgacgcaaacaccucuucguccaagacccacaaacaugcaaaugcuccugcaaaaacacagacucgcgcugcaaagcccgccaacucgaacuaaacgaacgcaccugccgcugcgacaaaccccgacgcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5520 - RNA, 906 nt, Artificial Sequence
  mRNA product Design5 comprising derived and/or modified sequence from Homo sapiens__NP_061986.1__HsFGF21(L126R,P199G,A208E) (opt11)
gggagagucccgcagucggcguccagcggcucugcuuguucgugugugugucguugcaggccuuauucaagcuuaccauggacuccgacgaaaccggcuucgaacacuccggccucugggucuccguccucgccggccuccuccuaggcgcaugccaagcccaccccauacccgacuccucaccccuccuccaauucggcggccaaguccgccaacgcuaccuauacaccgacgacgcccaacaaacagaagcccaccucgaaauccgagaagacggcacagucggcggcgccgccgaccaaagccccgaaucccuccuccaacucaaagcccucaaacccggcgucauccaaauccucggcgucaaaacaucccgcuuccuaugccaacgccccgacggcgcccucuacggcucacuccacuucgaccccgaagccugcuccuuccgcgaacgccuccucgaagacggcuacaacgucuaccaauccgaagcccacggccuaccccuacaccuccccggcaacaaauccccucaccgcgaccccgcaccccgcggccccgcccgcuuccuaccccuccccggccucccccccgcccuacccgaaccccccggcauccucgccccccaacccccagacgucggcuccucugacccccucuccauggucggcggcucccaaggccgcucacccuccuacgaauccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5521 - RNA, 2463 nt, Artificial Sequence
  mRNA product Design5 comprising derived and/or modified sequence from Mus musculus__NP_001276387.1__MmHGF (opt11)
gggagagucccgcagucggcguccagcggcucugcuuguucgugugugugucguugcaggccuuauucaagcuuaccaugauguggggaacaaaauuacuaccaguccuacuacuccaacacguccuacuccaccuacuacuacuccacgucgcaauccccuacgccgaaggacagaaaaagcgaagaaacacacuacacgaauuuaagaaaucagccaaaaccacccuaaccaaagaagacccccuacugaaaaucaaaacuaagaaagucaacuccgcagaugagugcgcaaaccgaugcauacgcaaccgcggcuucacauucacuugcaaagccuucguuuucgacaaaucacgaaaacgcugcuacugguaccccuuuaacucgaugagcucaggcgugaagaaaggcuucggccaugaguucgaccuauacgaaaauaaagauuacauacguaacugcaucaucggaaaagguggcagcuacaaaggcacugucucaauaacgaaaaguggcaucaaaugccaacccuggaacuccaugaucccucacgaacacucauuccuccccuccagcuacagagggaaagaccuacaagaaaacuacugccguaauccaagaggagaagaaggcggaccuuggugcuucaccuccaaccccgaaguaagauacgaagugugcgacauaccacaaugcuccgaagucgaaugcaugaccugcaacggcgaauccuaccgaggacccauggaccacaccgaaucagguaagaccugccaacgcugggaccaacaaacaccccacagacacaaauuccucccugaacgcuaccccgacaaaggcuucgacgacaacuacugcaggaacccagacgguaaaccccgacccugguguuacacccucgacccagauacacccugggaauacugcgccauaaaaacaugcgcacacuccgccgucaacgagacagacguccccauggaaaccaccgagugcauacaaggacaaggggaaggauacagaggaacaucaaacaccauuuggaacggcauacccugccaaagaugggacucccaguauccccacaaacacgacaucacaccagaaaacuucaaaugcaaggaccuacgagaaaacuacugccgcaacccagacggagcugaaucccccuggugcuucacaacagacccgaauauccgcgucggauacuguucgcaaaucccaaagugcgacgucagcucaggacaagacugcuacagaggaaacggcaagaacuauaugggcaaccuuucgaaaacacgcagcggccuaaccugcuccaugugggacaagaacauggaagaccuccaccggcacauauucugggaacccgacgcaaguaaacuuaacaaaaacuacugucgcaauccggacgacgacgcccacggcccuuggugcuacaccgguaacccccuaaucccgugggacuacugccccauaucccgaugcgaaggagauacaacacccaccaucgugaaccuagaccaccccgucaucucaugcgcuaaaacgaaacagcuccgagucgucaacggcaucccaacgcaaacgaccgucggauggauggucucccugaaauaccgcaacaaacacauaugcggcggaagccuaauaaaagaaagcuggguccuuacagcccggcaaugcuucccagcccguaacaaagaccucaaagacuacgaagccuggcucggcauccacgacguacaugaacgaggggaagaaaaacgcaaacaaauacucaacaucucccagcugguauacggcccggaaggaagcgaccucguccucuugaaacuagccagacccgccauacuagacaacuucgucagcaccaucgaccuccccucauacggcugcaccaucccagaaaagacaaccugcucaaucuacggcuggggcuacaccggacuaaucaacgccgacggacuccugcgggucgcccauuuguacaucaugggaaacgaaaaaugcucccaacaccaccaaggcaaagucacccugaacgaauccgaacucugcgcaggcgccgagaaaaucggaucaggacccugcgaaggggacuacgggggcccccucaucugcgagcaacauaaaaugcguauggugcuaggcgugaucguccccggacgcggaugcgccaucccgaaccgccccgggaucuucguccgcgucgccuacuacgccaaauggauacauaaagucauucucaccuacaagcuguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5522 - RNA, 924 nt, Artificial Sequence
  mRNA product Design5 comprising derived and/or modified sequence from Homo sapiens__NP_002119.1__HsHMGB1 (opt11)
gggagagucccgcagucggcguccagcggcucugcuuguucgugugugugucguugcaggccuuauucaagcuuaccauggggaaaggggacccgaaaaagccgaggggaaagaugucgagcuaugccuucuucgugcaaacgugcagggaggaacacaagaaaaagcacccggacgcgagcgugaacuucagcgaguucucgaaaaagugcucggaaagguggaagaccaugagcgcgaaagagaaagggaaauuugaagauauggcgaaagcggacaaggcaagguacgagcgagagaugaagacauauauaccaccaaagggcgagaccaagaaaaaguucaaggacccgaacgcgcccaagcgcccgccaucggccuuuuucuuguucuguagcgaguacaggcccaagaucaagggagagcacccgggcuugagcauaggcgacgucgcgaaaaagcucggggaaauguggaauaacacggccgcggacgauaaacagccauaugaaaagaaagcggccaagcuaaaggaaaaguacgagaaagauaucgcggcauaucgcgcgaaagggaaaccggacgcggccaagaaaggagucguaaaagcggaaaagagcaagaaaaagaaagaggaagaggaagaugaagaggacgaggaagaugaagaggaagaggaagaugaagaggacgaggacgaggaagaggacgaugacgaugaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5523 - RNA, 921 nt, Artificial Sequence
  mRNA product Design5 comprising derived and/or modified sequence from Mus musculus__NP_001273985.1__MmVEGFA (opt11)
gggagagucccgcagucggcguccagcggcucugcuuguucgugugugugucguugcaggccuuauucaagcuuaccaugaacuuccuccuauccuggguccacuggacacucgcccuccuccucuaccuccaccacgccaaauggucccaagcagcacccaccacagaaggcgaacaaaaaucccacgaagucaucaaguucauggacgucuaccaacgcucauacugccgccccaucgaaacacucguagacaucuuccaagaauaccccgacgaaaucgaauacaucuucaaacccuccugcgucccacuaaugcgcugcgccggaugcugcaacgacgaagcccucgaaugcgucccaaccuccgaauccaacaucaccaugcaaaucaugcgcaucaaaccccaccaaucccaacacaucggcgaaauguccuuccuccaacacucccgcugcgaaugccgccccaaaaaagaccgcaccaaacccgaaaaaaaaucaguccgcggcaaaggcaaaggucaaaaacgaaaacgcaaaaaaucacgcuucaaauccugguccguccacugcgaacccugcucagaacgacgcaaacaccucuucguccaagacccccaaaccugcaaaugcucaugcaaaaacaccgacucccgaugcaaagcccgccaacucgaacucaacgaacgaaccugccgcugcgacaaaccccgacgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5524 - RNA, 906 nt, Artificial Sequence
  mRNA product Design5 comprising derived and/or modified sequence from Homo sapiens__NP_061986.1__HsFGF21(L126R,P199G,A208E) (opt12)
gggagagucccgcagucggcguccagcggcucugcuuguucgugugugugucguugcaggccuuauucaagcuuaccauggacucugacgaaacagguuucgaacacucaggacuaugggucucaguauuagcaggacuauuauuaggagcaugucaagcacauccaauaccagacucaucaccacuacuacaauucggcggacaaguaagacaaagauacuuauacacagacgaugcacaacaaacagaagcacauuuagaaauaagagaagauggcacaguaggcggagcagcagaccaaucaccagaaucacuauuacaauuaaaagcauuaaaaccaggaguaauacaaauauuaggaguaaaaacaucaagauucuuaugucaaagaccugacggagcacuauacggaucacuacacuuugacccagaagcaugcucauuuagagaaagauuauuagaagacggauacaauguauaucaaucagaagcacacggauuaccauuacacuuacccggaaauaaaucaccacauagagacccagcaccaagaggaccugcaagauuucuaccucuaccaggacuaccaccagcacuaccugaaccaccaggaauauuagcaccacaaccaccagacguaggauccucagaccccuuaucaaugguaggcggaucacaaggaagaucaccaucauaugaaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5525 - RNA, 2463 nt, Artificial Sequence
  mRNA product Design5 comprising derived and/or modified sequence from Mus musculus__NP_001276387.1__MmHGF (opt12)
gggagagucccgcagucggcguccagcggcucugcuuguucgugugugugucguugcaggccuuauucaagcuuaccaugauguggggaacuaaauuacuaccaguucuauuacuucaacacguccuauuacauuuauuacuauuacacguugcaauaccauaugcagaaggacaaaaaaaaagaaggaacaccuuacacgaauuuaaaaaaucggcaaaaacaacccucacaaaggaagacccacuauuaaaaaucaaaacaaaaaaagugaauagugcagacgaaugugcaaauagaugcauaagaaacagaggauuuacauucacuuguaaagcauuuguauuugauaaaucaaggaaaagguguuauugguauccuuuuaacucaaugucuaguggaguaaaaaaaggauucggacaugaauuugaccuauaugaaaauaaagacuauauaagaaauugcauaauaggaaaagguggaucauauaaagggacaguuagcauaaccaaaucaggcauaaaaugucaaccauggaauucaaugauaccacaugaacauuccuuucuaccuaguaguuaucguggaaaagauuuacaagaaaauuauuguagaaacccaagaggagaagaaggagggccauggugcuuuacaagcaacccagaagucagauaugaaguaugugacauaccacaauguucagaaguagaauguaugacaugcaauggagaaucguauagagguccaauggaccauacagaaucaggaaaaacaugucaaagaugggaucaacaaaccccacaucgacauaaauucuuaccagaacgauauccagacaaaggguucgacgauaauuauugcagaaauccagaugggaaaccaagacccugguguuacacucuagaccccgauacaccaugggaauauugugcaauaaaaacaugcgcacacucagcaguaaaugagacugaugucccaauggaaacuacagaaugcauucaaggacaaggugaagguuaccgaggcacaaguaauacuauauggaaugggauaccaugucaaagaugggacagucaauacccacauaaacaugauauaacgccagaaaauuuuaaauguaaagauuuaagagaaaauuauugcagaaauccugauggcgcggaaaguccauggugcuucacaacugauccuaacauaagaguugguuauugcagucaaauaccuaaaugcgauguaucauccggacaagauuguuauagggguaauggaaaaaauuauaugggcaauuuaucaaaaacacguaguggauuaacauguucaaugugggauaaaaauauggaagauuuacaucgacacauuuucugggaacccgaugcuaguaaauuaaacaaaaacuauugucgaaacccagaugaugaugcacauggaccauggugcuauacagguaacccacuuauaccaugggacuauuguccuauaucaagaugugaaggcgauacaacaccuacuauagucaauuuagaucauccuguaaucaguugcgcuaaaacaaaacaauuaagaguuguaaacggaauuccaacacaaacaacaguaggauggaugguaucacucaaauaccgaaauaaacacauaugcggagguucuuuaauaaaagaaagcuggguauuaaccgcaagacaaugcuucccggcaagaaauaaagauuuaaaagauuaugaagcaugguuaggaauacacgauguacacgaaaggggagaagaaaaaagaaaacaaauacuaaauauaucacaauuaguauacggcccagaagggagcgaucuaguucuucuaaaauuagccagaccagcaauauuagauaauuuuguaucuacuaucgaucuaccaucauauggauguacaauaccugagaaaacaacauguucaauauauggauggggauauacuggauuaauaaacgccgauggacuucuuagaguagcacacuuauauauaaugggaaacgaaaaaugcucacaacaucaucaaggaaaaguuacacuaaacgaaucagaacuaugugcuggcgcagaaaaaaucggaucaggcccaugcgaaggugauuacggcggaccacuuauaugugaacaacauaaaaugcgcaugguauuaggagucauaguucccggucggggcugugcgauaccaaacagaccaggcauauuuguccguguagccuacuaugcaaaauggauacauaaaguaauauuaacauauaaauuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5526 - RNA, 924 nt, Artificial Sequence
  mRNA product Design5 comprising derived and/or modified sequence from Homo sapiens__NP_002119.1__HsHMGB1 (opt12)
gggagagucccgcagucggcguccagcggcucugcuuguucgugugugugucguugcaggccuuauucaagcuuaccaugggaaaaggagacccaaaaaaaccaagaggaaaaaugucaagcuacgcauucuucguacaaacaugcagagaagaacacaaaaaaaaacacccagacgcaagcguaaacuucagcgaauucagcaaaaaaugcucagaaagguggaaaacaaugagcgcaaaagagaaaggaaaauucgaagacauggcaaaagcagacaaagcaagauacgaaagagaaaugaaaacauacauaccaccaaaaggagaaacaaaaaaaaaauuuaaagacccaaacgcaccaaaaagaccaccaucagcauucuuccuauucugcagugaauacagaccaaaaauaaaaggagaacacccaggacuaagcauaggagacguagcaaaaaaauuaggagaaauguggaacaacacagcagcagacgacaaacaaccauacgaaaaaaaagcagcaaaauuaaaagaaaaauacgaaaaggacauagcagcauaucgagcaaaaggaaaaccagacgcagcaaaaaaaggaguaguaaaagcagaaaaaagcaaaaaaaaaaaagaagaagaagaagacgaagaagacgaagaagacgaagaagaagaagaagacgaagaagacgaagacgaagaagaagacgacgacgacgaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5527 - RNA, 921 nt, Artificial Sequence
  mRNA product Design5 comprising derived and/or modified sequence from Mus musculus__NP_001273985.1__MmVEGFA (opt12)
gggagagucccgcagucggcguccagcggcucugcuuguucgugugugugucguugcaggccuuauucaagcuuaccaugaacuuccuacuaucauggguacacuggacacuagcauuacuacuauacuuacaccacgcaaaauggucacaagcagcaccaacaacagaaggagaacaaaaaucacacgaaguaauaaaauucauggacguauaccaacgaucauacugcagaccaauagaaacacuaguagacauauuccaagaauacccagacgaaauagaauacauauucaaaccaucaugcguaccauuaaugagaugcgcaggaugcugcaacgacgaagcauuagaaugcguaccaacaucagaaucaaacauaacaaugcaaauaaugagaauaaaaccacaccaaucacaacacauaggagaaaugucauuccuacaacauucaagaugcgaaugcagaccaaaaaaagacagaacaaaaccagaaaaaaaaucaguaagaggaaaaggaaaaggacaaaaaagaaaaagaaaaaaaucaagauucaaaucauggucaguacacugcgaaccaugcucagaacgaagaaaacacuuauuuguacaagacccacaaacaugcaaaugcucaugcaaaaacacagacucaagaugcaaagcaagacaacuagaacuaaaugaaagaacaugcagaugugacaaaccaagacgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5528 - RNA, 906 nt, Artificial Sequence
  mRNA product Design5 comprising derived and/or modified sequence from Homo sapiens__NP_061986.1__HsFGF21(L126R,P199G,A208E) (opt13)
gggagagucccgcagucggcguccagcggcucugcuuguucgugugugugucguugcaggccuuauucaagcuuaccauggacucagacgaaacaggauuugaacacucaggacuauggguaucaguacuagcaggauuauuacuaggagccugccaagcacacccaauaccagacucaucaccauuauuacaauucggaggacaaguuagacaaagauaucuauauacagaugacgcacaacaaacagaagcacacuuagaaauaagagaagacggaacaguaggaggagcagcagaccaaucaccagaaucccuacuacaauuaaaagcacuaaaaccaggaguaauacaaauauuaggaguaaaaacaucaagauuccuaugccaaagaccagacggagcacuauacggcucacuacacuuugacccagaagcaugcucauucagagaaagacuacuagaagacggauauaauguauaucaaucagaagcacacggacuaccuuuacauuuaccaggaaacaaaucaccacacagagacccagcaccaagaggcccagcacgcuuuuuaccauuaccaggacuaccaccagcauuaccagaaccaccaggaauacuagcaccacaaccaccagauguuggaagcucagacccacuaucaaugguaggaggaucacaaggaagaucaccaucauaugaaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5529 - RNA, 2463 nt, Artificial Sequence
  mRNA product Design5 comprising derived and/or modified sequence from Mus musculus__NP_001276387.1__MmHGF (opt13)
gggagagucccgcagucggcguccagcggcucugcuuguucgugugugugucguugcaggccuuauucaagcuuaccaugauguggggaacaaaacuuuuaccuguucuauuauuacaacacguccuguuacacuuauuauuacuacauguagccauaccuuacgcagaaggacaaaagaaacgaagaaacacacuucaugaauuuaagaaauccgcaaaaacaacauuaacaaaagaagauccauuauuaaaaauaaaaacaaagaaaguuaauucagcagaugaaugugcaaauagauguauaagaaacagaggauuuaccuuuacauguaaagcauuuguauucgacaaaucaaggaaacgauguuacugguauccauucaauaguaugaguucuggaguaaagaaaggauucggucaugaguucgaccuauaugaaaauaaagacuauauuagaaauuguauaaucggcaaaggugggucuuauaaaggcacuguuaguauaacaaaaucaggaauaaaaugucaaccauggaauagcaugauaccacacgaacacucauuucucccaucuucauacaggggcaaagaccuacaagaaaauuauuguagaaacccaaggggagaagaaggaggcccaugguguuuuacaucgaauccugaaguacgauaugaaguaugugacaucccccaaugcagugaaguagaauguaugacuuguaauggugaaucauaccgaggaccuauggaccauacagaaucaggaaaaacuugccaacgaugggaucaacaaaccccucaucgacacaaauuuuuaccagaacguuacccagauaaaggauuugacgauaauuacuguagaaauccagacgguaaaccucgacccugguguuacacucuugauccagauacaccaugggaauauugcgcaauaaaaacuugcgcacauucugcaguaaaugaaacagacguuccaauggaaacuaccgaauguauacaaggccaaggagaaggcuauagagguacaucaaauacaauauggaauggcauacccugccaaaggugggacucucaauauccacauaaacaugauauaacaccagaaaacuuuaaauguaaagauuuaagagaaaauuacuguagaaauccggauggagcagaaucucccugguguuucacuaccgauccuaacauaagaguaggauauuguagccaaauaccuaaaugugauguuagcucaggucaagacugcuacagagguaauggcaaaaauuacauggggaaucucaguaaaacacguaguggacucacauguucaaugugggauaaaaauauggaagaccugcacagacauauauucugggaaccugaugcuucaaaauuaaauaaaaauuauugcagaaauccagaugaugacgcucacggaccaugguguuacacugguaauccauuaauaccaugggauuauuguccaauaucaagaugcgaaggugauacaacuccaacaauaguaaaucuagaucauccaguaauauccugugcaaaaacaaaacaacuaagaguaguaaacggaauaccaacacaaacaacaguaggauggaugguuaguuuaaaauacagaaauaaacauauauguggaggauccuuaauaaaagaaucauggguauuaacugcaagacaauguuucccagcaaggaacaaagauuuaaaagauuacgaagcauggcuaggaauacaugauguucacgaaagaggagaagaaaaacguaaacaaauuuugaacauuucacaacuuguauacggcccagaaggaucugauuuaguauuauuaaaguuagcaagaccagcaauucucgauaauuucguaucaacgauagaucuccccaguuacggcuguacgauaccagaaaagacaacaugcaguauauacggauggggauauacaggacuaaucaacgcagauggacuuuuaagaguagcccacuuauauauaauggguaacgaaaaauguucacaacaucaucaaggaaaaguaacacuaaaugaaagcgaauuaugugcaggcgcagagaaaauaggaagcggaccuugugaaggcgauuacgguggaccacuaauaugugaacaacauaaaaugagaaugguauuaggaguaauaguuccaggacguggaugugccauaccaaaccgaccaggaauauuuguuaggguagccuacuacgcaaaauggauucacaaaguaauauuaacauauaaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5530 - RNA, 924 nt, Artificial Sequence
  mRNA product Design5 comprising derived and/or modified sequence from Homo sapiens__NP_002119.1__HsHMGB1 (opt13)
gggagagucccgcagucggcguccagcggcucugcuuguucgugugugugucguugcaggccuuauucaagcuuaccaugggaaaaggagacccaaaaaaaccgagaggaaaaaugagcagcuacgcauuuuucguacaaacaugcagagaagaacacaaaaaaaaacacccagacgcaagcguaaacuuuagcgaauuuucaaaaaaaugcucagaaagauggaaaacaaugagcgcaaaagaaaaaggaaaauucgaagacauggcgaaagcagacaaagcaagauaugaaagagaaaugaaaacauacauaccaccaaaaggagaaaccaaaaaaaaauuuaaagacccaaacgcaccaaaaagaccaccaagcgcauucuuucuauucugcagugaauacagaccaaaaauaaaaggagaacacccaggauuaagcauaggagacguagcaaaaaaacuaggagaaauguggaacaacacagcagcagacgacaaacaaccauacgaaaaaaaagcagcaaaacuaaaagaaaaauacgaaaaagacauagcagcauauagagcaaaaggaaaaccagacgcagcaaaaaaaggaguaguaaaagcagaaaaaagcaaaaaaaaaaaagaagaagaagaagacgaagaagacgaagaagacgaagaagaagaagaagacgaagaagacgaagacgaagaagaagacgacgacgacgaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5531 - RNA, 921 nt, Artificial Sequence
  mRNA product Design5 comprising derived and/or modified sequence from Mus musculus__NP_001273985.1__MmVEGFA (opt13)
gggagagucccgcagucggcguccagcggcucugcuuguucgugugugugucguugcaggccuuauucaagcuuaccaugaacuuccuacuaucauggguacacuggacacuagcacuacuacuauacuuacaccacgcaaaauggagucaagcagcaccaacaacagaaggagaacaaaaaagccacgaaguaauaaaauucauggacguauaucaacgaucauacugcagaccaauagaaacacuaguagauaucuuccaagaauacccagacgaaauagaauacauauucaaaccaucaugcguaccauuaaugagaugcgcaggaugcugcaacgacgaagcacuagaaugcguaccaacaucagaaucaaacauaacaaugcaaauaaugagaauaaaaccccaccaaagccaacacauaggagaaaugucauuccuacaacacucaagaugcgaaugcagacccaaaaaagaccgaacaaaaccagaaaaaaaaucaguaagaggaaaaggaaaaggacaaaaaagaaaacgaaaaaaaucacgauucaaaucauggucaguacacugcgaaccaugcucugaaagaagaaaacaccuauucguacaagacccacaaacauguaaaugcagcugcaaaaacacagacucaagaugcaaagcaagacaacuagaauuaaacgaaagaacaugcagaugcgacaaaccacgaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5532 - RNA, 2398 nt, Artificial Sequence
  mRNA product Design6 comprising derived and/or modified sequence from Homo sapiens__NP_000592.3__HsHGF (opt1) R6258
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaa

SEQ ID NO: 5533 - RNA, 2422 nt, Artificial Sequence
  mRNA product Design7 comprising derived and/or modified sequence from Homo sapiens__NP_000592.3__HsHGF (opt1) R6259
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaa

SEQ ID NO: 5534 - RNA, 2411 nt, Artificial Sequence
  mRNA product Design8 comprising derived and/or modified sequence from Homo sapiens__NP_000592.3__HsHGF (opt1) R6260
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaa

SEQ ID NO: 5535 - RNA, 2435 nt, Artificial Sequence
  mRNA product Design9 comprising derived and/or modified sequence from Homo sapiens__NP_000592.3__HsHGF (opt1) R6261
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaa

SEQ ID NO: 5536 - RNA, 2474 nt, Artificial Sequence
  mRNA product Design10 comprising derived and/or modified sequence from Homo sapiens__NP_000592.3__HsHGF (opt1) R6262
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaa

SEQ ID NO: 5537 - RNA, 2498 nt, Artificial Sequence
  mRNA product Design11 comprising derived and/or modified sequence from Homo sapiens__NP_000592.3__HsHGF (opt1) R6263
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucucaaaggcucuuuucagagccaccaaaaaaaaaaaaaaaaaaaaaaaaaaaaaaaaaaaaaaaaaaaaaaaaaaaaaaaaaaaaaaaa

SEQ ID NO: 5538 - RNA, 849 nt, Artificial Sequence
  mRNA product Design12 comprising derived and/or modified sequence from Mus musculus__NP_001273985.1__MmVEGFA (opt1) R888/R889
gggagaaagcuuaccaugaacuuccugcucagcugggugcacuggacccuggcccugcuccuguaccugcaccacgcgaaguggucgcaggccgccccgacgaccgagggcgagcagaagagccacgaggucaucaaguucauggacguguaccagcggagcuacugccgccccaucgagacccucguggacaucuuccaggaguacccggacgagaucgaguacaucuucaagccgucgugcgucccccugaugcggugcgcggggugcugcaacgacgaggcccuggagugcgugccgacgagcgagagcaacaucaccaugcagaucaugcggaucaagccgcaccagucgcagcacaucggcgagaugagcuuccuccagcacagccgcugcgagugccggcccaagaaggaccggaccaagccggagaagaagucggugcgcggcaaggggaagggccagaagcggaagcggaagaagagccgcuucaagagcuggucgguccacugcgagccgugcagcgagcggcggaagcaccuguucgugcaggacccccagacgugcaagugcagcugcaagaacaccgacucgcgcugcaaggcccggcagcuggagcucaacgagcggaccugccgcugcgacaagccgcggcggugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 5539 - RNA, 630 nt, Artificial Sequence
  derived and/or modified CDS sequence (opt10) from Homo sapiens__NP_061986.1__HsFGF21
auggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauga

SEQ ID NO: 5540 - RNA, 1410 nt, Artificial Sequence
  derived and/or modified CDS sequence (opt10) from Homo sapiens__NP_002412.1__HsMMP1
augcauucguucccgccguuauuauuauuauuauuuuggggggucgucagccauucguuuccggccaccuuggagacccaggaacaggacgucgaucucgugcaaaaguauuuagagaaguauuauaauuuaaaaaacgacggccgccaggucgagaaaagacgcaacucggggccggucgucgagaagcucaaacagaugcaagaguuuuucggcuuaaaggucaccggcaagccggacgccgagacguuaaaagucaugaaacaaccgcgcugcggggucccggacgucgcccaauucguguugaccgaaggcaauccgaggugggaacagacccacuuaacguaucgcaucgagaacuauaccccggaccucccgcgcgccgacgucgaucacgcgaucgaaaaggcguuucaguuguggucgaacgugaccccguuaaccuuuacgaaagugagcgaagggcaggccgauauaaugaucagcuucgugcgcggggaccacagagauaauagcccguucgacgggccgggggggaacuuggcccacgccuuccagccggggccggggaucgggggcgacgcccacuucgacgaggacgagcgcuggacgaauaacuuucgcgaauauaaucuccacagggucgccgcccacgaguuggggcacagcuugggguugagucacagcaccgacauaggcgcccucauguauccgucguauacguuuucgggggacguccaauuggcccaagacgauaucgacgggauacaggcgaucuacgggaggagucagaacccggugcaaccgauagggccgcagacgccgaaggccugcgauucgaaauugacguucgacgccaucaccaccaucagaggggaggucauguuuuucaaggaucgcuuuuauaugaggaccaacccguuuuaucccgaggucgaauugaacuuuaucagcgucuuuuggccgcaguuaccgaacggcuuggaggccgccuaugaguucgcggaucgcgacgaggugagauucuuuaagggcaacaaauauugggccguccaagggcaaaacgucuugcauggguauccgaaagauauauauucgaguuucggguuuccgcgcaccgucaaacacauagacgccgccuugagcgaagagaauaccgggaagacguauuuuuucgucgccaauaaguauuggcgcuacgacgaguacaagaggagcauggacccgggguacccgaagaugaucgcccacgauuucccggggaucgggcauaaggucgacgccgucuuuaugaaggacggguucuuuuacuuuuuccacgggacccgccaguauaaguucgacccgaagaccaaacgcauccucaccuugcaaaaggccaacucgugguuuaauugucgcaagaacuga

SEQ ID NO: 5541 - RNA, 3066 nt, Artificial Sequence; identical to SEQ ID NO: 1096
  derived and/or modified CDS sequence (opt10) from Clostridium histolyticum__BAA34542.1__ColH

SEQ ID NO: 5542 - RNA, 2187 nt, Artificial Sequence
  derived and/or modified CDS sequence (opt10) from Homo sapiens__NP_000592.3__HsHGF
augugggucacgaaguuguuaccggcguuauuauuacaacacguguuguuacacuuguuguuauugccgauagcgauaccguaugccgaagggcagcgcaagcgccgcaauaccauccacgaguuuaagaagagugccaaaaccacguugauaaagaucgacccggccuuaaaaaucaagacgaaaaaggucaacaccgccgaucagugcgccaaccgcugcacccgcaacaagggguugccguuuaccuguaaagccuucgucuucgacaaggcccgcaagcaauguuugugguuuccguuuaacucgaugagcucgggggucaagaaggaguucgggcacgaguucgauuuguaugagaauaaggauuauauccgcaauuguauaaucgggaaagggaggucguauaaagggaccgucagcauaaccaaaucggggauaaaaugccaaccguggucgaguaugaucccgcaugagcauucguuccucccgagcucguacagagggaaggauuugcaagagaauuauugcaggaacccgaggggcgaggagggcgggccguggugcuuuaccucgaacccggaagucagguaugaggugugcgauaucccgcaaugcagcgaggucgaguguaugacguguaacggcgaaucguacaggggguugauggaccacaccgagagcgggaaaaucugccaaaggugggaccaccaaaccccgcauagacauaaauuucucccggagcgcuauccggauaaaggguucgacgacaacuacuguaggaacccggacgggcaaccccgcccgugguguuauaccuuggauccgcauacgaggugggaauauugcgccaucaaaaccugugccgauaacaccaugaacgauaccgacgucccgcucgagaccaccgaguguauacaggggcagggggagggguaucgcgggaccgugaacacgaucuggaacgggaucccgugccaaaggugggacagccaauauccgcaugaacacgauaugaccccggagaacuuuaaauguaaagauuugagggagaacuauuguaggaacccggacggcagcgagagcccguggugcuucacgaccgacccgaauauaagggucggguauuguagucagaucccgaauugcgacaugagccacgggcaagacugcuauaggggcaacgggaaaaacuacauggggaaucucagucagacccgcagcggguugaccugcagcaugugggauaaaaauauggaggaucuccacaggcacauauuuugggagccggacgccucgaaauuaaacgaaaacuauuguaggaacccggacgacgacgcccacgggccgugguguuauaccgggaacccguugaucccgugggacuauuguccgaucaguaggugcgagggggacacgaccccgaccaucgugaaccucgaucacccggucaucagcugcgcgaagaccaagcagcucagggucgucaacggcaucccgaccaggaccaauaucggguggauggucucgcuccgcuaucgcaacaagcacauauguggggggagccucaucaaagaaucgugggucuugaccgccaggcaaugcuuuccgagcagggaucucaaggacuacgaggccugguuggggauccacgacgugcaugggcgcggggacgaaaaguguaagcaagucuugaacgucagucaauuagucuacgggccggaggggagcgacuuaguccucaugaaauuggcgcgcccggccguguuagacgacuucgucucgaccaucgaccucccgaauuacggguguaccaucccggagaaaacgucguguucggucuauggguggggguauaccgggcucauaaauuacgacggguugcucagggucgcccacuuguauaucauggggaacgaaaaguguucgcaacaccacaggggcaaagucaccuuaaacgaaagcgagaucugcgccggcgccgagaaaaucgggagcgggccgugcgaaggcgacuauggggggccguuggucugcgaacagcacaaaaugcgcauggucuugggggugaucgucccggggagggggugcgcgaucccgaacaggccggggaucuucgugagggucgccuacuacgccaaguggauccauaagaucauccucaccuauaaagucccgcaaagcuga

SEQ ID NO: 5543 - RNA, 576 nt, Artificial Sequence
  derived and/or modified CDS sequence (opt10) from Homo sapiens__NP_001133.1__HsAMELX
auggguacguggauacucuucgcgugcuuguuaggugcggcguucgcgaugccguuaccgccgcacccaggccacccgggauacaucaacuucucguacgaggucuuaacgccgcucaagugguaccagaguauccgaccuccuuaccccucguacggauacgagccgaugggggguugguuacaccaccagauaauaccaguauugagucagcaacacccgccaacgcacacuuuacagccgcaccaccacauccccguaguccccgcgcagcaaccggucaucccgcaacagccgaugaugccgguacccgggcagcacucgaugacaccuauccagcaccaccaaccgaacuugccgccgccggcgcagcaacccuaccagccacagccgguccagccucaaccccaccagccuaugcagccucagccgccgguacacccgaugcagccguuaccaccgcagcccccguuaccgcccauguucccgaugcaaccccucccgccgauguuaccggacuuaacguuagaggcguggccuucgacggacaagacgaagcgcgaggagguugacuga

SEQ ID NO: 5544 - RNA, 135 nt, Artificial Sequence
  derived and/or modified CDS sequence (opt10) from Homo sapiens__NP_001133.1__HsAMELX-TRAP
augccguugccgccgcauccgggucacccgggguauauaaacuucucguaugaggucuugacgccgcucaagugguaccaaucgauucgcccgccuuacccgaguuauggguacgagccgaugggggggugguga

SEQ ID NO: 5545 - RNA, 579 nt, Artificial Sequence
  derived and/or modified CDS sequence (opt10) from Homo sapiens__NP_001134.1__HsAMELY
auggguacauggauauuauucgcgugcuuggucggugcugcauucgcaaugccauuaccuccccacccaggccacccgggguacauuaauuucucguacgagguauuaacgccgcuuaaaugguaccagaguaugaucaggccgccguacucgucguacggauacgaacccaugggggguugguuacaucaccagauaauaccgguagucucgcagcagcacccguuaacgcacacguugcaaucgcaccaccacauaccgguaguaccggcgcagcaaccucgcguuaggcagcaggcguuaaugccgguaccggggcagcagucgaugacaccgacccagcaccaccagccgaacuuaccauuacccgcucaacagccauuccagccgcaacccguccagccgcaaccccaucagccgaugcaaccgcaaccgccgguacagccgaugcagccguuguuaccgcagccgccguugccacccauguucccguuacgcccuuuaccuccgaucuuaccggacuuacacuuagaggcauggccggcgacggacaagacgaagcaggaggagguagacuga

SEQ ID NO: 5546 - RNA, 138 nt, Artificial Sequence
  derived and/or modified CDS sequence (opt10) from Homo sapiens__NP_001134.1__HsAMELY-TRAP
augccguugccgccgcacccgggccauccgggguacauaaauuuuucguacgaagucuugacgccgcucaaaugguaucaaucgaugauccgcccgccguauagcaguuacggguaugaaccgaugggggggugguga

SEQ ID NO: 5547 - RNA, 2961 nt, Artificial Sequence
  derived and/or modified CDS sequence (opt10) from Homo sapiens__NP_006120.1__HsBMP1
augcccggagucgcgcgauugccauugcucuuagguuuguuauuauuaccacgcccggggaggccccucgacuuagcggacuacacguacgacuuggcagaggaggacgacucugaaccuuuaaacuacaaggacccgugcaaggcugccgcguucuuaggggacauagcguuggacgaggaggacuuacgcgcuuuccaaguccagcaggcgguugacuuaaggcgccacacggcgcggaaaaguucgaucaaggcggcgguacccgggaacacaaguacgccgucgugccaaaguacaaacggacaaccacagcgcggggcgugcggacgguggcgagggaggucgaggaguaggcgagcagccaccucgcgucccgagcggguauggccggacgguguaauuccauucguaauagguggcaacuucacgggaagucagcgggcgguauuccgccaggcgaugcgacacugggagaaacacacaugcguuacguucuuggagcgaaccgacgaggacucguacauaguauuuacguaccguccaugcggcugcugcaguuacguagggcgaagggguggcgguccgcaagcgaucucgauagguaagaacugcgacaaguucgguaucguaguucacgaguuaggucacguuguagguuucuggcacgagcacacgcgaccugaccgcgacaggcacgucaguauaguccgcgagaacauacagccgggacaggaguacaacuucuuaaaaauggagccgcaagagguugagucguugggugagacguacgacuucgacucgauaaugcacuacgcgcgaaacacguucucgcgcgggauuuucuuagacacaauaguuccgaaauacgagguaaacggcgucaagccgccgauaggccagcggacucgcuugucgaagggugacauagcgcaggcgcggaaguuguauaagugcccggcgugcggugagacauuacaggacucgacgggaaacuuuaguucgcccgaguacccuaacggcuacucggcgcacaugcacugcgucuggcgaauaucgguaacuccgggggagaagauuauuuuaaauuucacuucauuggauuuauauaggucgcgauuauguugguacgacuacguagaaguaagggacggguuuuggcguaaggccccuuugcgugggcgauucugcggaucgaaguuaccggagccgauaguaaguacggacucgcguuuauggguagaguuccgaaguucgaguaacuggguagguaaggguuucuucgccguuuacgaggcaauaugcgguggggacguaaagaaggacuacggucauauacagucuccgaauuacccggacgacuacaggccuaguaagguauguauauggcgcauccaagucucggagggauuccauguuggguugacguuucagaguuucgagauagagaggcacgacucgugcgcguacgauuacuuagagguaagggacggacauucggagucgaguacuuuaauaggacgauacugcgguuacgagaagccggacgacauaaagucgacuucgucgcgauugugguuaaaguucguuucggacggaaguauaaacaaggcagguuucgcgguuaacuucuuuaaggagguagacgagugcucgcgaccgaaccgaggcgguugcgagcaacgaugcuuaaacacguugggaucuuacaaaugcucuugcgacccggguuacgaguuggcgccggauaagaggcgaugcgaggcggcaugcggggguuucuuaacaaaguugaacgguucgauaacaucgcccggguggccgaaggaguacccgccgaacaagaacugcauauggcaauuagucgcgccgacacaauaccggauuucguuacaguucgacuucuucgagacggaggguaacgacgucuguaaguacgacuucgucgagguccgaucggguuugacugcggacucaaaguuacacgguaaguucugcggcucggagaagccggagguaauuacaucgcaguacaacaacaugcgagucgaguucaagucggacaacacgguaaguaagaagggguucaaggcacacuucuucucggauaaggacgaguguucgaaagacaacggggguugccaacaggacugcguaaacaccuucgguucguacgagugucagugccgaucggguuucguauuacacgacaacaagcacgacugcaaggaggcaggaugcgaccauaaggucacgucgacuucggggacgauaacgucgccgaacuggccggacaaguacccgucgaagaaggagugcaccugggcgaucucgucaacuccgggucaucgaguuaaguugacguucauggagauggauauugagucgcagcccgagugcgcguacgaccacuuagagguauucgacgggcgugacgcgaaagcaccgguauuaggaagguucugcgguucgaagaaacccgaaccgguuuuggcgacgggaagucguauguucuuacgguucuacucggacaauaguguacaacguaagggguuccaagcaucgcaugcgacggagugcgguggucagguccgagcggacguuaaaacgaaagacuuauacucgcacgcgcaguucggggacaauaacuacccgggcgggguugacugcgaguggguuauagucgcagaggagggguacgguguagaguuaguauuccagacuuucgaggucgaggaggagacggacugcgguuacgacuacauggaguuauucgacgguuacgacucgacggcgccacgauuagguagguacugcgggucgggaccgccggaggagguauacucagccggugacaguguauuagucaaguuucacucugacgacacgauaacgaagaagggcuuccacuuacguuacacgaguacgaaguuccaggacacguuacacucucgaaaguga

SEQ ID NO: 5548 - RNA, 1191 nt, Artificial Sequence
  derived and/or modified CDS sequence (opt10) from Homo sapiens__NP_001191.1__HsBMP2
auggucgcgggcacgagguguuuguuggcacucuuauugccgcaaguauuguuagggggggccgcgggguugguccccgaguuagggaggcgcaaguucgccgccgcaagcagcgggaggccgagcagucagccgagcgacgagguauuaucggaguucgagcucagauuauugucgauguucggguuaaaacaacgcccgacgccgucgcgcgacgcggucgucccgccguauauguuggacuuauauaggcgccacagcgggcagcccgggagcccggcgccggaccacagacucgagcgcgcggcgucgagggcgaacacggucaggucguuccaccaugaagaaagccucgaagaauugccggaaacaucgggcaaaacgacgagacgcuucuucuuuaaucucucgagcauaccgaccgaggaguuuauaacgagcgccgaguugcaagucuucagggaacagaugcaagaugcgcucgggaacaauucgucguuccaucacaggauaaauauauaugaaauaauuaaaccggccacggcgaacagcaaauucccggucacgcgcuugcucgacacgcgccucgucaaucagaaugcgucgcgcugggaaucguuugauguaacgccggcggucaugagauggaccgcccaggggcacgcgaaccauggguucgucgucgaagucgcgcaccucgaggagaaacaagggguaaguaagcgccauguccgcauuucgcgcagccuccaccaagaugaacacucguggagccagauucgcccgcucuuggucacguuugggcaugaugggaaaggccauccguugcacaaacgcgaaaaaaggcaagcgaaacacaaacaaagaaaaagguugaagaguucguguaagcgccacccgcucuacgucgacuucucggacgucgguuggaaugacuggauagucgccccgccuggcuaucacgcguuuuauugccacggggaaugcccguuuccguuagccgaucauuuaaacaguacgaaucaugcgauaguccagacacucguaaacagcgucaacagcaagauaccgaaagcgugcuguguacccacggaauugucggcgauaagcauguuauauuuggacgagaaugaaaaggucguccucaaaaauuaucaggacauggucgucgagggguguggcuguagguga

SEQ ID NO: 5549 - RNA, 1227 nt, Artificial Sequence
  derived and/or modified CDS sequence (opt10) from Homo sapiens__NP_001193.2__HsBMP4
augauaccgggaaacaggauguuaaugguaguauuguugugccagguauuauuggguggugccucgcacgcgaguuugaucccggagaccgguaagaagaagguagcggagauccagggccacgcggggggccgacguagcggucagucgcacgaguuauugcgagacuucgaggccacgcucuuacagauguucggucuucgccgaaggccgcagccgucuaagucggccgucauacccgacuacaugcgagacuuauaccgauuacagucgggcgaggaggaggaggagcagauccacaguacgggguuagaguacccggagcguccggccucgcgagcgaacacgguccgcucguuccaccacgaggagcacuuggagaacauaccgggcaccucggagaacagugcguucagauucuuauucaacuuaucgaguaucccagagaacgaggugauaucuagugcggaguugcgcuuauuccgugagcagguugaccaagggccggacugggagcgcggcuuccaccgaaucaacaucuacgaggugaugaagccgccggcggagguaguacccggucacuuaaucacucgucucuuagacacgcgauuaguacaccacaacguaacgaggugggagacguucgacgucaguccggcgguauugagguggacgcgcgagaagcagcccaacuacggauuagcgaucgaggucacgcaccuacaccagacccguacgcaccagggccagcacguccgaauaucgcgaucgcuaccgcagggaucggguaacugggcgcaauuaagaccguuguuaguaacguucggccacgacgggcgaggccacgcuuuaacgcgucgacgacgugcgaagcgcucgccgaagcaccacucgcagcgagcgcgaaagaagaacaagaacugccgacgucacagucuuuacguugacuucucggacgucggauggaacgacuggauaguugcgccgccgggcuaccaggcguucuacugccacggggacugcccguucccguuagccgaccacuuaaacaguaccaaccacgccaucguccagacgcuuguaaacucgguaaacaguucaauacccaaggcgugcugcguacccacggaguuaagugcgaucucgauguuauacuuggacgaguacgacaagguuguuuuaaagaacuaccaggagaugguuguggagggcugcggaugccguuga

SEQ ID NO: 5550 - RNA, 1542 nt, Artificial Sequence
  derived and/or modified CDS sequence (opt10) from Homo sapiens__NP_001709.1__HsBMP6
augcccggcuuaggcagacgcgcccaaugguuauguuggugguggggcuuauuauguucguguuguggcccgccccccuuaagacccccgcucccggccgcggccgcggcggcggcgggcggccaauuauuaggcgaugggggcucgccggggaggaccgaacaacccccccccagcccccaaaguaguagcggguuuuuauauagaagauugaaaacccaagaaaaaagagaaaugcaaaaagaaauacucagcgucuuaggcuugccccauagaccgagaccguuacauggguugcagcaaccccaaccgcccgccuugagacaacaagaagaacaacaacaacaacaacaauuaccgaggggggaaccgccgccgggcagguuaaaaagugccccguuguuuauguuagacuuauauaaugcguuaagugcggauaaugaugaagauggcgccagcgaaggcgaacgccaacaaaguuggccgcaugaggccgcgucgagcagucaaaggagacaacccccgcccggggcggcccaucccuugaauaggaaaucguuguuagcgccggggagcgggucggggggggccaguccguuaacgucggcccaagauucggcguuuuugaaugaugccgauauggugaugucguucgucaauuuagucgaauaugauaaagaauuuaguccgaggcaaaggcaucauaaggaauuuaaauuuaaucucagucaaaucccggaaggggaagucgucaccgccgccgaguuuaggauauauaaagauugcgucaugggcucguucaagaaucagaccuucuugauaucgaucuaccaggugcuccaagaacaccaacaucgcgauagcgauuuauuccuccucgauacgagggucgucugggcgagcgaggaggggugguuagaguucgauauaaccgcgaccucgaacuuaugggucgucaccccgcaacacaauaugggcuugcaauuaucggucgucacccgcgacggggugcaugugcauccgagggcggccggguuagucgggcgcgaugggccguaugauaaacaaccguuuauggucgccuuuuuuaaggucucggaaguccaugucaggacgacgcgcagcgcgaguucgagaaggaggcagcaaucgaggaacaggagcacgcaaagucaagaugucgccagagugaguucggccagcgacuauaauucgucggagcucaagaccgcgugucgcaaacacgaauuauacgucucguuucaggauuuaggguggcaagauuggauaaucgccccgaaaggguacgccgcgaacuauugcgacggggaguguaguuuuccguugaaugcccauaugaacgccacgaaucaugccaucguccaaacgcucguccauuugaugaauccggaauacgugccgaagcccuguugcgccccgaccaaauugaacgcgauaagcgucuuguauuucgacgauaauaguaacgugaucuuaaagaaguaucgcaacauggucguccgcgccugcgggugucauuga

SEQ ID NO: 5551 - RNA, 1296 nt, Artificial Sequence
  derived and/or modified CDS sequence (opt10) from Homo sapiens__NP_001710.1__HsBMP7
augcacguaagaucguuacgagcggcggcuccgcacaguuucguagcguugugggccccguuauucuuauugcgaucggcguuagcggacuucaguuuagacaacgagguacacucgaguuucauacaccgaagauugcgcucgcaggagaggcgcgagaugcagcgagagauauuaaguauauuaggguugccgcaccgacccaggccccacuugcaggggaagcacaacucggcuccaauguucauguuagacuuauacaacgcgauggcgguagaggagggggggggucccgggggucagggcuucaguuaccccuacaaggcgguauucucuacgcaggguccgccguuagcgaguuuacaggacucgcacuucuugacggacgcggacaugguaaugaguuucguaaacuuaguagagcacgacaaggaguucuuccacccgcgauaccaccacagggaguuccgauucgacuuaucgaagauacccgagggggaggcgguaacggcggcggaguucaggauauacaaggacuacauccgagagagauucgacaacgagacguuccgaauaaguguauaccagguauugcaggagcacuuagguagggagucggacuuauucuuguuagacagucgcacguuaugggcgucggaggaggguugguuggucuucgacauaacggcgacgaguaaccacugggucguaaaccccaggcacaacuuagguuuacaguugucgguagagacauuagacggucagucgauaaacccgaaguuagccggguugaucggucgacacggcccgcagaacaagcagccguucaugguagccuucuucaaggcgacggagguacacuucaggaguauaaggucgacggguaguaagcagcgaucgcagaacaggaguaagacaccaaagaaccaggaggcguuaagaauggcgaacguagcugagaacucgaguucggaccagaggcaggcgugcaagaagcacgaguuauacguaaguuuccgcgacuugggguggcaggacuggauaauagcgccggagggguacgcagcguacuacugcgagggugagugcgcguuccccuuaaacucguacaugaacgcgacgaaccacgcgauaguacagacguuaguacacuucaucaacccggagacaguaccgaagccgugcugcgcgccgacgcaguugaacgcgauaaguguauuauacuucgacgacucgaguaacguaaucuuaaagaaguacaggaacaugguaguacgagcgugcgguugccacuga

SEQ ID NO: 5552 - RNA, 300 nt, Artificial Sequence
  derived and/or modified CDS sequence (opt10) from Homo sapiens__NP_006264.2__HsCCL7
augaaggcgucggccgcguuacuaugcuuauuacuuaccgccgcggcguucucgccgcagggcuuagcgcaaccgguagguauaaacaccaguacgacaugcugcuacagguucauaaacaagaagaucccgaagcagcgauuagagaguuaccgucguacgacgagcucucacugcccgcgugaggcggucauauucaaaacgaaguuagacaaggagauaugcgcagaccccacccagaaguggguacaggacuucaugaagcacuuagacaagaagacgcagacgccuaaguuguga

SEQ ID NO: 5553 - RNA, 3624 nt, Artificial Sequence
  derived and/or modified CDS sequence (opt10) from Homo sapiens__NP_001954.2__HsEGF
auguuauugaccuugauaaucuuacucccggucgucagcaaguucucguucgucucguugagcgccccccaacauuggucgugcccggaggggaccuuggccgggaacggcaacaguaccugcgucgggccggccccguuucucaucuuuagucacgggaacucgauauuccgcaucgauaccgaggggacgaacuacgaacagcucgucgucgacgccggggugagcgucauaauggacuuccacuacaacgaaaagcgcauauacugggucgaccucgagcgccaguugcuccagcgcgucuucuuaaacggcagccgccaggaacgcgucugcaacaucgaaaagaacgucagcgggauggccaucaacuggaucaacgaggaggucaucuggagcaaccagcaagaggggauaaucaccgucaccgacaugaaggggaacaacagucauaucuugcucucggcccucaaguacccggccaacgucgccgucgacccggucgagcgcuucaucuucuggagcagcgaagucgccgggucguuguaccgcgccgacuuggacggggucggggucaaagccuuacucgaaaccagcgaaaagaucaccgccgucagccucgacgucuuggacaaaagauuauucuggauccaauauaaucgcgaggggucgaacagcuugaucuguaguugcgacuacgacggggggagcgugcauaucucgaagcacccgacccaacacaaccucuucgccaugaguuuguucggggauaggauauuuuacagcaccuggaagaugaaaaccaucuggaucgcgaauaagcauaccgggaaagauaugguccgcaucaauuugcacagcagcuucgucccguugggggaguuaaaggucguccacccguuggcccagccgaaagccgaggacgauaccugggaaccggaacaaaaguuguguaagcuccgcaaggggaauuguucgucgaccgucugcggccaggauuugcaaagccaucucuguaugugcgccgaaggguaugcguugucgagggauagaaaauauugcgaggacgucaacgagugcgccuucuggaaccacgggugcaccuugggcugcaagaauacgccggggaguuacuauuguaccuguccggucggguucgucuuauugccggacggcaagaggugccaccaguuggucaguugcccgaggaacgucagcgaguguucgcacgauugcgucuuaaccagcgaggggccgcucugcuuuugcccggaggggagcgucuuggaacgcgacggcaagaccugcucggggugcaguagcccggacaacggggggugcucgcaauugugugucccguugucgccggucaguugggagugcgacuguuucccgggcuacgauuugcaguuagacgagaagucgugcgccgccagcgggccgcagccguuccucuuauucgcgaacagccaggacaucaggcauaugcacuucgacgggaccgauuacgggaccuuauugucgcaacaaauggggauggucuacgcguuggaccacgauccggucgagaacaaaaucuauuucgcgcacaccgcguuaaaauggaucgaacgcgccaacauggacgggagucaaagggagcgcuugaucgaagagggggucgacgucccggagggguuggccgucgauuggaucgggaggcgcuuuuacuggaccgaucgcggcaagagcuuaaucgggcgcucggaccucaacggcaagaggaguaagaucauaaccaaagaaaauauaagccagccgagggggaucgccguccacccgauggcgaaacgccucuuuuggaccgacaccggcaucaacccgaggaucgagucgagcaguuugcagggguuggggagguuagucaucgcgucgagcgacuugauauggccgucggggaucaccaucgauuuucucaccgauaaacucuauuggugugacgcgaaacaaagcgucaucgagauggcgaacuuagacgggagcaagaggaggcgcuugacgcaaaacgacgucgggcauccguucgccgucgccgucuucgaagacuacgucugguuuagcgacugggccaugccgagcgucaugcgcgucaauaaacgcaccgggaaggaccgcgucagguugcaggggucgauguuaaaaccgagcagcuuagucgucguccacccgcucgccaagccgggggccgacccgugucucuaccagaauggggggugcgagcacaucuguaagaaacgcuuggggaccgccuggugcagcugcagggagggguucaugaaggcgagcgacggcaagaccugcuuagccuuagacgggcaccaauuacucgccgggggggaggucgacuugaaaaaucaggucaccccgcucgauauacucaguaaaacccgcgucagcgaggacaauaucaccgagagccagcauauguuggucgccgagauaauggucagcgaccaggacgauugcgccccggucggguguucgauguacgccagaugcaucagcgaaggggaagacgcgaccugccaaugccucaagggguucgccggcgacgggaaguugugcagcgacaucgacgagugcgaaaugggggugccggucuguccgccggcgaguaguaaauguauaaauacggaggggggguacguguguagauguagcgagggguaucagggggacggcauccauugcuuggacaucgacgaaugucaguuaggcgaacauucgugcggggaaaacgcgucguguaccaacaccgaagggggguacacguguaugugcgccgggagguuaagcgagccgggguuaaucuguccggauagcaccccgccgccgcauuugcgcgaggacgaucaucauuacaguguccgcaacucggauagcgagugcccguuaagucaugacggcuauuguuugcacgacggggucuguauguacaucgaggcccucgauaaauacgccuguaauugcgucgucggguauauaggcgaaaggugccaauauagggauuuaaaauggugggaguuaaggcaugccgggcauggccaacaacaaaaagugauagucgucgccgugugugucgucgucuuggugauguuauuguuguuaucguuauggggcgcgcauuauuaucgcacccaaaaauuauugagcaagaauccgaaaaacccguacgaagaaagcucgcgcgacguccgcucgaggcgcccggccgauaccgaagacggcaugaguagcuguccgcagccgugguucgucgucaucaaggagcaucaggauuugaaaaacggcgggcagccggucgccggggaagacgggcaagccgccgacggcagcaugcagccgaccagcuggcgccaagaaccgcaacucugcgggauggggaccgaacagggguguuggaucccggucaguucggacaaagggaguugcccgcaagucauggaaaggucguuccacaugccgaguuacggcacccaaacguuggagggcgggguggaaaaaccgcacagcuuguugagcgccaauccgcucuggcagcagcgcgcguuagauccgccgcaucagauggaauuaacccaauga

SEQ ID NO: 5554 - RNA, 510 nt, Artificial Sequence
  derived and/or modified CDS sequence (opt10) from Homo sapiens__NP_001423.1__HsEREG
augacggccggccgccgcauggaaauguugugcgcggggcgcgugccggccuuauuauuguguuuaggguuucacuuguugcaagccguguugucgaccaccgucaucccgagcugcauaccgggggaaaguucggacaauuguaccgcccucguccaaaccgaggauaacccgagggucgcccaggucagcaucaccaaaugcucgagcgauaugaacggguacugccuccacgggcaauguauauacuuagucgauaugucgcagaauuauugucgcugcgaggucggguacaccggggugaggugcgagcauuuuuuccucacggugcaucagccgcucucgaaggaguacgucgcccucacggucaucuugaucauccucuucuugauaaccgugguggggaguaccuacuacuuuugucgcugguaucgcaacaggaagucgaaggagccgaaaaaagaguacgaacgcgucacgagcggcgacccggaacucccccagguguga

SEQ ID NO: 5555 - RNA, 468 nt, Artificial Sequence
  derived and/or modified CDS sequence (opt10) from Homo sapiens__NP_000791.1__HsFGF1
auggcggagggugagauaacgacguucacugcguuaacggagaaguucaacuuaccgccggguaacuacaagaagcccaaguuguuauacugcucgaacggggggcacuucuuacgaauauuaccagacggcacgguagacgguacccgagaccggucggaccagcacauccaguuacaauuaucggcggagaguguuggcgagguauacaucaagucgacugagacagggcaguacuuggcgauggacacggacggguuauuguacgggagucaaacgccgaacgaggagugcuuauucuuagagcgcuuggaggagaaccacuacaacacguacaucucgaagaagcacgcggagaagaacugguucguaggguuaaagaagaacgguaguugcaagcgggggccacgcacgcacuacggucagaaggcgaucuuauucuugccguuaccaguaucgagugacuga

SEQ ID NO: 5556 - RNA, 867 nt, Artificial Sequence
  derived and/or modified CDS sequence (opt10) from Homo sapiens__NP_001997.5__HsFGF2
auggugggcgucgggggcggggacguggaggacgugaccccgcgcccgggcgggugccagaucucgggccggggcgcccgcgggugcaacggcauccccggggccgcggccugggaggccgcccugccccggcgccggccccgccggcacccguccgucaacccccgcucgcgggccgcgggcucgccccgcacccgggggcgccggacggaggagcgccccuccggcucccggcucggcgaccgcgggcggggccgcgcccugcccgggggccggcugggcgggcgcggccgggggcgcgcccccgagcgcgugggcgggcggggccgcggccgggggaccgccgcgccccgcgccgcccccgccgcccggggcucgcgcccggggcccgcgggcaccauggccgccggguccaucaccacgcuccccgcccugcccgaggacggcggcucgggggccuucccgcccggccacuucaaggaccccaagcggcuguacugcaagaacgggggcuucuuccuccgcauccaccccgacgggcggguggacggcguccgcgagaaguccgacccgcacaucaagcugcagcugcaggcggaggagcggggcguggugucgaucaagggggucugcgccaaccgcuaccucgccaugaaggaggacggccggcugcuggccuccaagugcgugaccgacgagugcuucuucuucgagcgccucgagucgaacaacuacaacaccuaccggucccgcaaguacaccucgugguacguggccuuaaagcggacggggcaguacaaguuaggcuccaagaccggccccgggcagaaggcgauccucuucuuacccaugucggccaaguccuga

SEQ ID NO: 5557 - RNA, 585 nt, Artificial Sequence
  derived and/or modified CDS sequence (opt10) from Homo sapiens__NP_002000.1__HsFGF7
augcacaaguggauauuaacguggauauugccgacguuauuauacaggucgugcuuccacauaauaugcuuggucgggacaauaaguuuagcgugcaacgacaugacgcccgagcaaauggcgacgaacguaaauugcucgaguccggagagacacacgaggucguaugacuauauggaggggggcgacauaagagucaggagauuauucugcaggacacaaugguauuugagaauagacaagaggggcaaagucaaggggacgcaagagaugaaaaacaacuauaacauaauggagauaagaacgguagccgucggcauagucgcgauaaaagggguagagagugaguucuauuuagcgaugaacaaggaggggaaguuauaugcgaagaaggagugcaacgaggacugcaauuucaaggaguugauauuagagaaccacuauaacacguacgcgucggccaaguggacacacaacggcggggagauguucgucgcguuaaaccaaaagggcauaccggucagggggaagaagacgaagaaagagcaaaagacggcgcacuucuugccgauggcgauaacguga

SEQ ID NO: 5558 - RNA, 627 nt, Artificial Sequence
  derived and/or modified CDS sequence (opt10) from Homo sapiens__NP_001936.1__HsHBEGF
augaaguuguuacccucaguuguacucaaauuauucuuagcggccguauuaagugcucuugugaccggcgagucguuggagcguuugcgccgcggucuugcagcgggcacgaguaacccggacccgccgacggucucgaccgaccaguuacucccucucgggggcgggcgcgaccguaagguucgggaccuccaggaggcggacuuagaccuccuacguguuacgcuuucgucgaagccccaggccuuggcgaccccuaacaaggaggagcacgguaagcguaagaagaaggggaaggggcuuggcaagaagcgugacccgugcuugcgaaaguacaaggacuucugcauacacggggagugcaaguacgucaaggaguuacgagcgccgaguugcaucugccacccgggcuaccacggggagcgaugccacggcuugucguuaccgguagagaaccguuuguacacuuacgaccacacuaccauacucgccguagucgcgguugucuuaucgucgguaugcuuauuaguaauaguaggcuuauuaauguuccgauaccaccgacgcgggggcuacgacguagagaacgaggagaaggugaagcuagggaugacgaacucgcacuga

SEQ ID NO: 5559 - RNA, 2187 nt, Artificial Sequence; identical to SEQ ID NO: 5542
  derived and/or modified CDS sequence (opt10) from Homo sapiens__NP_000592.3__HsHGF

SEQ ID NO: 5560 - RNA, 1926 nt, Artificial Sequence
  derived and/or modified CDS sequence (opt10) from Homo sapiens__NP_005336.3 __HsHSPA1A
auggcgaaggcggcggcaauagggauagacuuagguacgacguacucgugcguugguguauuccagcacgguaagguagagauaauagcgaacgaccaggguaaccggacgacgccgaguuacgucgcguucaccgacacggagcgcuugaucggggacgccgcgaagaaccagguagcuuuaaacccacaaaacacgguuuucgacgcaaagcgacucauagggcgaaaguucggggaccccgucguacaaucagacaugaagcacuggccguuccaggucauaaacgacggugacaagccgaagguccagguaaguuacaagggcgagacgaaggcguucuacccugaggagaucucaaguaugguauugacgaagaugaaggagauagcggaggcauacuuaggauaccccgugacgaacgccguaaucacgguccccgcguacuucaacgacucucagcggcaggcgacgaaggacgcaggcguaaucgcaggguuaaacguauugcgcaucauaaacgagccgaccgcggcggcgauagcauacggguuagaccggaccgggaagggugagcgaaacguauuaaucuucgacuuggguggggguacguucgacgucucgauauuaaccaucgacgacggcauauucgagguaaaggcgaccgccggggacacgcacuuaggcggggaggacuucgacaaccgauuggucaaccacuucguagaggaguucaagcgaaagcacaagaaggacauaucgcagaacaagcgugcgguaagaagguuacgaacggcgugcgagcgggcuaagcgcacguuaaguucgaguacgcaggcgucguuggagauagacaguuuauucgaggguauagacuucuacacuucgauaacgcgugcacgauucgaggaguuaugcucggacuuauucaggucgacguuagagccgguagagaaggcauuacgagacgcgaaguuggacaaggcacagauacacgacuuaguauuaguaggugguucgacgcggauaccgaagguacagaaguuguuacaggacuucuucaacggucgagacuuaaacaagucgaucaacccggacgaggcgguagcguacggggccgcgguacaggccgcgauauugaugggugacaagagugagaacguacaggacuuauuauuauuagacguagcacccuuaucuuuggguuuagagaccgcggguggggucaugacggcguuaauaaagcgaaacucgacgaucccgacgaagcagacccagaucuucacuacguacucggacaaccagccggguguauugauccagguauacgagggugagcgagcgaugaccaaggacaacaacuuauuaggacguuucgaguugucggguauaccgcccgcaccucgaggggucccgcagaucgaggucacguucgacaucgacgcgaacgguaucuuaaacguaacggcgaccgacaaaaguacggggaaggccaacaagaucacgauaacgaacgacaagggucgauuaucgaaggaggagauagagaggaugguccaggaggcagagaaguacaaggccgaggacgagguccagagagagcgaguaagugcgaagaacgcguuggagucguacgcguucaacaugaagagugcggucgaggacgaggguuuaaaggguaagaucucggaggccgacaagaagaaggucuuagacaagugccaggagguuauaucuugguuagacgcgaacacguuagcggagaaggacgaguucgagcacaagcgcaaggaguuagagcagguaugcaacccgauaauaucggguuuguaccagggggcgggcgggccggguccgggugguuucggcgcgcagggaccgaagggugguagugggucggguccgacgaucgaggagguagacuga

SEQ ID NO: 5561 - RNA, 1926 nt, Artificial Sequence; identical to SEQ ID NO: 5560
  derived and/or modified CDS sequence (opt10) from Homo sapiens__NP_005337.2 __HsHSPA1B

SEQ ID NO: 5562 - RNA, 1926 nt, Artificial Sequence
  derived and/or modified CDS sequence (opt10) from Homo sapiens__NP_005518.3 __HsHSPA1L
auggcgacggcgaaggguauagcuauagguauagacuuaggaacgacauacucgugcguaggugucuuccagcacgggaaggucgagaucauagcuaacgaccaggggaacaggacaacgccgaguuacgucgcguucaccgacacugagagauugaucggugacgcggcgaagaaccaggucgcgaugaacccucaaaacacgguauucgacgcgaagcgguuaaucggucgcaaguucaacgacccggucguucaggcggacaugaaguuauggccguuccaaguaauaaacgagggcggaaagccgaagguauugguaucguacaagggugagaacaaggcauucuacccggaagagauaaguucgaugguuuuaaccaaguuaaaggagacagcggaggcguucuuaggucauccgguaacuaacgcgguaaucacgguacccgcuuacuucaacgacagucagcggcaggcgacgaaggacgcgggggucauagcggguuuaaacguauuacgcauaauaaacgagccaacggcagcggcgauagcguacggucuugacaaggggggacagggugagcggcacguauuaaucuucgacuuagguggcgguacauucgacgucucgauauugacgaucgacgacgguauauucgagguaaaggcgacggcgggugacacgcacuuagguggugaggacuucgacaacagauuaguaagucacuucgucgaggaguucaagcggaagcacaagaaggacauaucgcaaaacaagcgcgcuguaaggagauugcggacggccugcgagcgcgcgaagcggacguuaaguucgucgacgcaggcgaaccucgagauagacucguuguacgaggguauagacuuuuacacgaguaucacgcgagcgagauucgaggaguuaugcgccgacuuauuccgcgggacauuggagcccguugagaaggcguuaagggacgcgaagauggacaaggcgaagauccacgacauaguauuagucggugguucgacccgaauaccgaagguacagcgguuauuacaagacuacuucaacggucgcgacuugaacaagucgauaaacccggacgaggcgguagcguacggggcggcaguccaggcggcgauauuaaugggggacaagucggagaagguccaagacuuauuauuguuggacguugcgccguuaaguuuagguuuagagacugcgggcgguguaaugacggcguuaaucaagcggaacucgacaauaccaacgaagcagacgcaaauauucacuacguacagugacaaccagccggguguauugauacagguauacgagggugagcgggcgaugacgaaggacaacaacuuauuaggucguuucgacuuaacugguauaccuccggcuccgcgggggguaccgcaaauagaggucacguucgacauagacgcgaacgggaucuuaaacguaacggcgaccgacaagucgacagguaagguuaacaagauaacuauaacgaacgacaaggguagauuaucgaaggaggagaucgagaggauggucuuggacgcggagaaguacaaggcagaggacgagguacagagagaaaagauagcggcgaagaacgcguuagagaguuacgcguucaacaugaagucgguaguaucggacgagggauuaaaggguaagaucucggagagugacaagaacaagauauuagacaagugcaacgaguuauuaucgugguuggagguuaaccaguuagcggagaaggacgaguucgaccauaagaggaaggaguuagagcaaaugugcaacccgaucaucacgaaguuauaccagggggguugcacggguccggcgugcgguacggguuacgucccugggcgaccggcaacagguccgacgauagaggagguagacuga

SEQ ID NO: 5563 - RNA, 1920 nt, Artificial Sequence
  derived and/or modified CDS sequence (opt10) from Homo sapiens__NP_068814.2 __HsHSPA2
augucggccagggggccggccauagggaucgauuuggggacgacguauagcugugucggggucuuucaacaugggaagguggagaucauagccaaugaucagggcaaucgcacgaccccgaguuacgucgcguucaccgauacggagagguugauaggggaugccgcgaaaaaucaagucgccaugaauccgaccaauaccauauuugaugccaaacgcuugauagggaggaaauuugaggaugccaccgugcagucggauaugaaacauuggccguuuagggucgucagugagggggggaagccgaaaguacagguggaguauaagggggaaaccaaaacguucuuuccggaggaaauaagcucgauggucuugacgaagaugaaggagaucgccgaagccuacuugggggggaaagugcauucggccgucaucaccgugccggccuauuucaaugauucgcagcgccaggccaccaaggaugccgggacgaucaccggguugaauguguugaggaucauaaacgagccgaccgccgccgccauagccuauggguuggauaaaaaggggugugcggggggggaaaagaauguguugaucuuugauuuggggggcgggaccuuugaugugagcaucuugacgaucgaggaugggauauuugaagugaagucgaccgcgggggauacccauuuggggggcgaggauuuugauaauaggauggucucgcacuuggcggaggaauuuaagcgcaaacauaaaaaggacaucgggccgaauaagagagccguccgccgcuugcgcacggccugugagagagccaagcgcacguugucgagcucgacccaggccucgaucgagauagauaguuuguaugagggcgucgauuuuuauacgagcauaaccagagcgagguucgaagaguugaaugcggacuuauuuagggggaccuuggagccgguggagaaggccuugagggaugccaagcucgauaaggggcagauccaggagaucguguuagugggggggaguacgaggauaccgaagauacagaaguuguugcaggauuuuuuuaauggcaaggaguugaauaagagcaucaauccggacgaggccguggcguauggggccgccguccaggccgccaucuugauaggcgauaagucggaaaaugugcaggauuuguuguuauuggaugucacgccguugagcuugggcaucgaaaccgccgggggggucaugacgccguuaaucaagaggaauaccacgaucccgaccaagcaaacgcaaacguuuaccacguauucggauaaucaaagcagugucuuggugcaagucuaugaaggggagagggccaugaccaaggauaauaauuugcucgggaaauuugauuugaccgggauccccccggccccgaggggggucccgcagauagaggugaccuucgauaucgaugcgaaugggauauugaaugucacggccgcggauaagucgaccggcaaagagaauaaaauaaccaucaccaaugauaagggccgcuuaucgaaggaugauaucgauaggauggugcaggaggccgagagguauaagagcgaggacgaagccaaucgcgauaggguggccgccaaaaaugccuuagagagcuauacguauaauauaaaacaaacgguggaggaugagaaguuaagggggaagaucucggagcaggauaagaauaagaucuuagauaagugccaggaggugaucaauugguuggauaggaaucagauggcggagaaggaugaguaugagcauaagcagaaggaguuggagagggucuguaauccgaucauaagcaagcucuaucagggggggccgggggggggcucgggggggggggggaguggggccucgggggggccgacgauagaggaggucgacuga

SEQ ID NO: 5564 - RNA, 2523 nt, Artificial Sequence
  derived and/or modified CDS sequence (opt10) from Homo sapiens__NP_002145.3 __HsHSPA4
augucagucguagguaucgaccucgguuuucaaaguuguuacguagcgguagcgcgagcuggagguauagagacgauagcaaacgaauacucggaccgaugcacuccugcgugcauaucguucgggccgaagaacaggucgauaggggccgcggcaaagucgcagguuaucucaaacgcgaaaaacacgguacaggguuucaagcgauuucacggucgugcguucucggacccuuucgucgaggccgagaagaguaacuuagcguacgacauaguucaauuaccgacgggucucacgggcauuaagguaacuuacauggaagaggagcgcaacuucacuacggagcagguaacggcgauguuguuaucgaaguuaaaggaaacggcagagucgguauuaaagaagccagugguagacugcguaguaucaguaccgugcuucuacacggacgcggagcggcguucgguuauggacgccacgcagauagcggggcucaacuguuuacgccuaaugaacgagacgacggccguagcguuagcguacgggauuuacaagcaggacuugccagcgcuugaggagaagccgcgcaacguuguauucguggacaugggacacucggcauaccaggugucggucugcgcguucaaccgggggaagcucaaggucuuagcgacggcguucgacaccacguuaggcggacgcaaguucgacgagguacucguuaaccacuucugcgaggaguucgguaagaaguauaaguuagacauaaagucgaagauucgagcguugcuucguuuaucgcaggagugcgagaaguuaaagaaguuaaugucagcgaacgcgucggacuugccccuuucgaucgagugcuucaugaacgacguagacguuucagggaccaugaacagggggaaguucuuagagauguguaacgacuuauuggcacgagucgaaccucccuugaggucggucuuagagcagacaaaguugaagaaggaggacauauacgcgguagagaucgucggaggggcaacgcguauuccggcaguuaaggagaagauaucgaaguucuucggcaaggaguuaucgacgacgcuuaacgcggacgaggcgguaacgagggguugcgcguuacagugcgcuauacuuucuccagcguucaagguacgcgaguucucgauaacggacguuguuccguaccccaucaguuuacgguggaacucgccggcggaggaggguucgucggacugcgagguguucucgaagaaccacgcggcgcccuucucgaaggucuuaacguucuaccgaaaagagccguucacauuagaggcauacuacaguucgccacaggaccuuccuuacccggacccggcgaucgcacaguucucgguacaaaagguuacgccccagucggacgguucgucgucgaaggucaagguaaaggugaggguuaacguucacgguaucuuuucggucaguucggcgucgcuuguagagguccacaagucggaggagaacgaggagccgauggagacggaccagaacgcgaaagaggaggagaaaaugcagguagaccaggaggagccgcacguagaggagcagcaacagcagacgccggcggagaacaaggcggagucggaggagauggagacuucgcaggcgggcucgaaggacaagaaaauggaccagccuccgcaggcgaaaaaggcgaaggucaagacaucuaccgucgacuuaccgauagagaaccaguuauuguggcaaaucgaccgagagauguuaaacuuauacaucgagaacgaggggaaaaugaucaugcaggacaaguuggaaaaggagcgcaacgacgcgaaaaacgcgguugaggaguacguuuacgagaugcgugacaaguuaucgggcgaguacgagaaguucgucucggaggacgaccgaaacucauucacguuaaaguuggaggacacggagaacugguuauacgaggacggggaggaccaaccgaagcagguauacgucgacaagcuagcggagcuuaagaacuugggacagcccauaaagaucagguuccaagagagugaggagcgcccgaagcuauucgaggaguuagguaagcaaauacagcaguacaugaagaucauaucuaguuuuaagaacaaggaggaccaauacgaccacuuagacgcggcagacaugacuaaggucgagaagaguacgaacgaggcgauggaguggaugaacaauaaguuaaacuuacaaaacaagcagucguuaacgauggacccgguaguaaagucgaaggagaucgaggccaagaucaaggaguuaaccucuacaugcucgccaaucauaucgaagccgaagccgaagguagagccgccgaaggaggagcagaagaacgccgagcaaaacggccccguagacggucagggugacaaccccgggccucaggcggcagaacaggggacggacaccgcgguaccgucugacucggacaaaaaguuaccggagauggacaucgacuga

SEQ ID NO: 5565 - RNA, 2520 nt, Artificial Sequence
  derived and/or modified CDS sequence (opt10) from Homo sapiens__NP_055093.2 __HsHSPA4L
augagcgucgucgggaucgauuugggguucuugaauuguuauauagccguggcccgcucgggggggauagaaacgauagcgaacgaauauucggaucgcuguacgcccgcgugcaucagccucgggagccgcaccagggcgauagggaacgccgccaaaucgcaaaucgugaccaauguccgcaacaccauccacggguuuaagaaauugcacggcaggagcuucgacgauccgaucguccagaccgagcgcauacgcuugccguacgaauuacaaaagaugccgaacgggucggccggggucaaagucagauaucucgaagaggaacgcccguucgccaucgaacaagucaccgggauguuacucgcgaaauugaaggaaaccagcgagaacgcccucaaaaagccggucgccgauugcgucaucagcaucccgucguuuuucaccgacgcggaacgccgcagcgucauggccgccgcgcaagucgccgggcucaacugccuccgccucaugaacgagaccaccgccgucgccuuagccuacgggaucuacaagcaagacuugccgccgcucgacgaaaagccgcgcaacgucgucuucaucgacauggggcauagcgcguaccaagugcucgucugcgccuuuaauaaagggaaguugaaggugcucgccaccacguucgacccguaccucggggggcgcaauuucgacgaagcccucgucgauuauuuuugcgacgaauuuaaaacgaaguacaaaaucaacgucaaggagaauagcagagcgcuccucaggcucuaccaagaaugcgagaaguugaaaaaauugaugucggccaacgccagcgacuugccgcucaauaucgaaugcuuuaugaacgauuuggacgucagcucgaagaugaaucgcgcccaguucgaacaauuaugcgccaguuugcucgcgcgcgucgagccgccgcucaaagccgucauggagcaagccaaucuccaaagggaggauaucucgucgaucgagaucgucgggggggccaccaggaucccggccgucaaggagcaaauaaccaaguuuuucuugaaggauaucucgacgacccucaacgccgacgaggccgucgcccgcgggugcgcccuccaaugcgccaucuugagcccggccuucaaggucagggaguucaguaucaccgauuuggucccguacagcauaacccuccgcuggaaaacgagcuucgaggacgggucgggcgagugcgaggucuuuugcaaaaaucauccggcgccguuuagcaaagugaucaccuuucauaaaaaagagccguucgaguuggaggccuucuacaccaaccuccaugaggucccguauccggacgcccgcaucggcucguuuaccauccaaaacgucuucccgcaaagcgacggggacucgaguaaggucaaagucaaggucagggucaauauacacgggauauuuucggucgccucggccagcgucaucgaaaaacagaaccucgagggggaccauucggacgccccgauggaaaccgagaccagcuucaagaacgagaauaaggacaacauggacaagaugcaagucgaccaagaggagggccaccagaagugccacgccgagcauaccccggaggaagagaucgaccauaccggggcgaagaccaaaagcgccgugagcgauaagcaagauaggcucaaccaaaccuugaagaaggggaaaguaaagucgaucgacuugcccauacaaucgucguugugccgccaauuggggcaagacuuguuaaauucguauaucgagaacgaaggcaaaaugauaaugcaagacaaacucgaaaaggagcgcaacgacgccaaaaacgcggucgaggaguacgucuacgacuuccgcgaucgcuuagggaccguguacgagaaguuuauaaccccggaagaucucucgaaauuaagcgccguccucgaggauaccgaaaacugguuguacgaggauggggaagaucaaccgaagcaggucuacgucgacaaauugcaggaguugaaaaaguaugggcaaccgauccaaaugaaauauauggaacacgaagaacgcccgaaggcgcucaacgaucucgggaaaaaaauacaauuggugaugaaagucaucgaagccuaccgcaauaaagacgagcgcuacgaccacuuagacccgaccgaaauggagaaagucgagaagugcauaucggacgcgaugucgugguuaaacucgaaaaugaacgcccaaaauaaguugucguugacccaggacccggucgucaaggucagcgagaucgucgccaaaagcaaagaguuagacaacuuuugcaauccgauaaucuauaaaccgaaaccgaaggccgaggucccggaggauaagccgaaggccaacucggaacauaacgggccgauggacgggcaaucggggaccgagaccaagagcgacagcaccaaggauucgagccaacacaccaaaaguagcggggaaauggaggucgauuga

SEQ ID NO: 5566 - RNA, 1965 nt, Artificial Sequence
  derived and/or modified CDS sequence (opt10) from Homo sapiens__NP_005338.1__HsHSPA5
augaaauugaguuuagucgcggccauguuauuauuauugucggccgccagagcggaagaagaagauaaaaaagaagaugucgggaccgucguggggauagauuuaggcacgacguauaguugugugggggucuuuaaaaaugggagggucgaaauaauagcgaaugaccaagggaauaggauaacccccaguuacguggcguuuaccccggagggcgagagguuaaucggggacgcggcgaaaaaucaauugacgaguaauccggaaaauaccguguucgaugcgaaaagauugauagggaggaccuggaacgaucccagcguccaacaagauauaaaauuucuccccuuuaaagucgucgagaaaaagaccaagccguauauccaggucgacaucggggggggccagaccaaaaccuucgccccggaggagaucagcgcgauggucuugaccaagaugaaggagacggccgaagccuaccucgggaaaaaagucacgcacgccgucgucaccgucccggcguacuucaacgacgcgcagaggcaggccacgaaggaugccgggaccaucgccggguugaacgucaugcgcauaauaaaugaaccgaccgccgccgccaucgccuacggguuagacaaacgcgaaggcgaaaaaaauauauuagucuucgauuuagggggggggacguuugacgucagcuuguugacgaucgauaacgggguguuugaggucgucgcgaccaacggggacacccacuuagggggggaggauuucgaucaaagggugauggagcauuuuauaaaguuauauaagaaaaaaaccgggaaggacgugcgcaaggauaaccgcgccguccaaaaguugagaagggaagucgagaaagcgaagagagcguuaagcagccaacaccaggcccgcaucgagaucgaaaguuuuuacgagggggaggauuucagcgaaacguuaaccagagcgaaguucgaggaauugaauauggacuuauuuagaagcaccaugaaaccggugcaaaagguccucgaggacagcgaccucaaaaaaagcgacaucgacgagaucgucuuggucggggggagcaccaggaucccgaaaauccaacaguuagucaaggaauuuuuuaacgggaaagagccgaguagggggaucaauccggacgaggccgucgccuacggggccgccgugcaagccggggucuugagcggggaccaggacaccggggauuuagucuuauuggacgucugcccguugaccuuggggaucgagaccgucgggggggugaugacgaaguuaaucccgcgcaauaccgucgucccgacgaaaaaaagccaaauauucagcaccgccagcgacaaccagccgaccgucaccauaaaaguguacgagggggagcgcccguuaaccaaggauaaccacuuguuagggaccuucgacuuaaccgggaucccgccggccccgaggggcgugccgcaaaucgaggugacguucgaaaucgacgucaacgggaucuugagggucaccgccgaggauaaagggaccggcaauaagaacaaaauaaccauaacgaacgaucaaaacagguuaaccccggaggagauagagcgcauggucaacgacgccgaaaaauucgccgaagaggauaagaaauugaaagaaaggaucgacacccgcaacgaacucgagucguacgcguacagcuugaaaaaccaaaucggggacaaggagaaauuaggggggaaguugaguagcgaggacaaagaaacgauggagaaggccgucgaggagaaaaucgagugguuagagucgcaucaggacgccgauaucgaggauuuuaaggccaaaaaaaaagaguuagaggagaucguccagccgaucauaucgaaguuguacgggucggccgggccgccgccgaccggggaggaagacaccgccgagaaggacgaacucuga

SEQ ID NO: 5567 - RNA, 1932 nt, Artificial Sequence
  derived and/or modified CDS sequence (opt10) from Homo sapiens__NP_002146.2__HsHSPA6
augcaagcgccgagagaauuggccgucgggauagauuuagggacgacguauagcugugucggggucuuccaacaagggagggucgaaauauuagcgaaugaucaagggaauaggacgaccccgucguaugucgcguuuacggauacggaaagauuagugggcgaugccgcgaaaucgcaagccgcguuaaauccgcauaauacggucuuugacgcgaaaagauuaauaggcaggaaauuugccgauacgaccguccaaagcgauaugaaacauuggccguuuagagucgucucggaaggggggaaaccgaaagucagggucuguuauaggggcgaagauaaaaccuuuuauccggaagaaauaagcaguauggucuuaucgaaaaugaaagaaaccgcggaagccuauuuagggcaaccggucaaacaugccgucauaacggucccggcguacuuuaacgauagccaaaggcaagcgacgaaagaugccggcgcgauagccggcuugaauguccucagaauaauaaacgaaccgaccgccgccgcgauagcguacggcuuagauagaagaggggccggggaaaggaaugucuugaucuucgauuuagggggcgggacguuugacgucagcgucuugaguaucgaugccgggguguucgaagucaaggcgaccgccggggacacgcauuuagggggggaagauuuugauaauagauuggucaaucauuuuauggaggaguuuagaagaaaacacggcaaagauuuaucgggcaauaaaagggcguuaaggcgcuuaaggaccgcgugcgaaagggcgaaaaggacguuaaguaguucgacgcaagcgacguuagaaaucgauaguuuauuugaaggggucgauuuuuauaccaguauaaccagggcgagguucgaagaguuauguagcgauuuguuuaggucgacguuagaacccgucgaaaaagcguuaagagacgcgaaauuagauaaagcgcaaauccacgaugugguguuagucggcgggaguaccaggauaccgaaaguccaaaaacucuuacaagauuuuuuuaaugggaaagaauuaaauaaaucgauaaauccggacgaagccgucgcguacggcgccgccguccaagccgcgguccucaugggcgauaagugcgaaaagguccaagacuuguuauuauuagacgucgccccgcucagcuuaggcuuagaaaccgccgggggcgucaugacgaccuuaauacaacgcaaugcgaccauaccgacgaaacaaacgcaaaccuuuacgacguauagcgauaaucaaccgggcguguuuauacaagucuacgaaggggaacgcgcgaugacgaaagauaauaauuuauuaggcagguucgaguugucggggauaccgccggcgccgaggggggugccgcaaaucgaagucaccuucgauaucgacgccaacgggauauuaucggucaccgcgaccgaucgcucgaccgggaaagccaauaaaauaacgauaacgaacgauaaagggagauuaucgaaagaagaagucgaacgcaugguccacgaggcggaacaauauaaagccgaagacgaagcgcaacgcgaucgcgucgccgcgaagaauagcuuagaagcgcacguguuucacgucaaggggagccuccaggaagagucguugcgcgauaaaaucccggaggaagaucgcaggaagaugcaggauaaaugcagagagguguuggcgugguuagaacauaaucaauuagccgaaaaagaagaauacgaacaccaaaaacgcgaauuagaacagauaugcaggccgauauuuagucgcuuguacggcggcccgggggugccgggcgggucgucgugcgggacccaggcgaggcaaggcgauccgucgacggggccgauaaucgaagaagucgacuga

SEQ ID NO: 5568 - RNA, 1104 nt, Artificial Sequence
  derived and/or modified CDS sequence (opt10) from Homo sapiens__P48741__HsHSPA7
augcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagucgcaggccgcgcucaacccccacaacacgguguucgacgccaagcgcuuaaucggccggaaguucgccgacaccaccguccagagcgacaugaagcacuggcccuuccagguggugucggagggcgggaagcccaaggucagggugugcuaccggggcgaggacaagaccuucuacccggaggagaucagcagcaugguguuauccaagaugaaggagacggccgaggcguaccucgggcagcccgucaagcacgccgugaucaccgugcccaccuacuucucgaacagccagaggcaggccaccaaggacgccggcgccaucgcggggcugaaggucuuacccaucaucaacgaggccacggccgccgccaucgcguacggccucgacagacgcggcgccgggaagcggaacgugcugaucuucgacuuaggcgggggcaccuucgacgugagcgucuugaguaucgacgccggcguguucgaggugaaggccaccgccggggacacccacuuaggcggggaggacuucgacaaccgccuggucaaccacuucauggaggaguucagacgcaagcacggcaaggaccucucggggaacaagcgggcguuaaggcgguuaaggacggccugcgagcgggccaagaggaccccgaguagcuccacccaggccacccucgagaucgacagcuuauucgagggcguggacuucuacaagaguaucacgcgggccagguucgaggaguuaugcagcgacuuguucagguccaccuuagagcccguggagaaggcguuaagagacgccaagcucgacaaggcccagauccacgacuucgucuuaggcgggggccugcacagccacccccagggggccgagguggcggccggccuccugcagcgccagggggccgagcaggagcaccagcccuga

SEQ ID NO: 5569 - RNA, 1941 nt, Artificial Sequence
  derived and/or modified CDS sequence (opt10) from Homo sapiens__NP_006588.1 __HsHSPA8
augucgaaggggccggcgguagguauagacuuaggcacgacguacucgugcguagggguauuccagcacggcaagguagagaucaucgcgaacgaccaggggaaccgaacaacgccgucguacguagcauucaccgacacggagcgcuuaauaggcgacgcggcgaagaaccagguagcgaugaacccgacuaacacggucuucgacgcgaagcgguuaaucggucgacgguucgacgacgcgguaguacagucggacaugaagcacuggcccuucauggucguuaacgacgcagguagaccgaagguacagguggaguacaagggcgagaccaagucguucuacccggaggaggucucgucgaugguguuaaccaagaugaaggagaucgcggaggcguacuuggguaagacggugacgaacgcagucguuacggucccggcguacuucaacgacagucagcgacaggcgacuaaggacgcggguacgaucgcgggauuaaacgucuuacgaaucaucaacgagccgacggcggccgcgauagcguacgggcuagacaagaagguaggugcggagaggaacguauuaaucuucgacuuggggggcgggacguucgacguaucgauauuaaccaucgaggacgguauuuucgagguaaagaguaccgcaggggacacccacuuagggggggaggacuucgacaaccguaugguaaaccacuucauagcggaguucaagcggaagcacaagaaggacauaucggagaacaagcgcgccguacgacguuuacggacggcgugcgagagagcgaagcgaaccuuaaguucgaguacucaggcaucgauagagauagacucguuauacgaggggaucgacuucuacacgucgaucacgcgagcgcgguucgaggaguugaacgccgacuuguuccgagggacgcuugacccgguggagaaggcguuacgggacgcuaaguuagacaagagucagauacacgacauaguauuaguaggggggucgacgcgaaucccuaagauacagaaguuauugcaggacuucuucaacggcaaggaguuaaacaagaguauaaacccggacgaggcaguagccuacggggcggcgguacaggcggcgauucucucgggugacaagucggagaacgugcaggacuuauuauuauuagacguaacgcccuuaucgcucgggaucgagacggcgggggggguaaugacgguauugaucaagaggaacacgacgauaccgacgaagcaaacgcagacguucacgaccuacucggacaaccagccgggcguauuaauacagguauacgagggcgagcgggccaugacgaaggacaacaaccuuuuagguaaguucgaguuaacggguauuccgccggcgccgagggggguaccgcaaaucgagguaacguucgacauagacgcgaacgggauccuuaacguaagugcgguagacaagucgacggguaaggagaacaagaucacgauaacgaacgacaagggccgcuuaaguaaggaggacaucgagcgcaugguacaggaggcggagaaguacaaggcggaggacgagaagcagcgagacaagguaucgucgaagaacucguuggagaguuacgcguucaacaugaaggcgacgguagaggacgagaaguuacaggguaagaucaacgacgaggacaagcagaagaucuuggacaagugcaacgagauaaucaacugguuagacaagaaccagacggcggagaaggaggaguucgagcaccagcaaaaggaguuagagaagguaugcaacccgaucauaacgaagcuauaccaguccgcgggugggaugccgggggggaugccgggcgguuuccccggagggggugccccgccgagugggggggcgucgucgggcccgacgaucgaggaggucgacuga

SEQ ID NO: 5570 - RNA, 2040 nt, Artificial Sequence
  derived and/or modified CDS sequence (opt10) from Homo sapiens__NP_004125.3 __HsHSPA9
augaucucggcgucgagggccgccgccgcgagguuggucggggcggccgcgaguagagggccgaccgcggcgaggcaucaagacucguggaacggguugucgcacgaagccuuccgcuuggucagccgcagagacuacgccagcgaggcgauaaaaggggccgucgucgggaucgaucucgggaccacgaauaguugugucgccgucauggaggggaagcaagcgaaagucuuagaaaacgcggagggggcgcgcacgacgccgagcgucgucgcguucaccgccgacggggaaagguuggucgggaugcccgcgaaaaggcaagccgugacgaauccgaauaauaccuucuacgccacgaaaagguugaucgggagaagguacgacgacccggagguccaaaaggauaucaagaacgucccguuuaagaucgugagggcgaguaacggggacgcgugggucgaagcccauggcaagcucuacagccccucgcaaauaggggccuucguccucaugaaaaugaaggaaaccgccgagaacuaucucggccauaccgccaagaacgccgucauaaccgugccggccuacuuuaacgauagccaacgccaagcgaccaaagacgccgggcaaauuagcggguuaaacgucuugagagucaucaacgaaccgaccgccgccgccuuggcguacggguuggauaagagcgaggauaagguaaucgccgucuacgaccucgggggggggaccuucgacaucagcauauuagagauccaaaagggggucuucgaagucaagaguaccaacggcgacacguuucucgggggcgaggauuucgaucaagcgcucuugagacauaucgucaaagaauuuaaacgcgaaaccggcgucgaccucaccaaagauaauauggccuugcaacgcgucagagaggccgccgagaaagccaagugcgaguugaguagcagcguccaaaccgauauaaaccucccguacuugaccauggacagcagcgggccgaaacaccucaacaugaaacucacgagggcccaguucgagggcaucgugaccgacuugauacgccgcaccauagccccgugucaaaaggccaugcaggacgccgagguaucgaaaucggauaucggggaggucauauuggucggggggaugacccgcaugccgaaaguccaacaaaccguccaagauuuguucgggcgcgcgccgucgaaagccgugaacccggacgaagccgucgcgaucggggccgcgauccaaggggggguccucgcgggggacgugaccgacgucuuauuguuggacgugaccccgcucagcuuagggaucgagaccuugggggggguguucacgaaguugaucaaccgcaacacgaccaucccgacgaaaaaaucgcaagucuuuagcaccgcggccgacgggcagacccaggucgagaucaaggucugucaaggggagcgcgaaauggccggggauaauaaguuguuggggcaauucacccucaucgggaucccgccggcgccgaggggggucccgcaaaucgaggucaccuucgauaucgacgcgaacggcaucguccacgucagcgccaaggacaaggggaccgggagggaacaacaaaucgucauacaaagcagcggggggcucucgaaggacgacaucgagaacauggucaaaaacgccgaaaaauacgccgaggaggauagaaggaaaaaagagagggucgaggcggucaauauggccgaggggauaauccaugauaccgaaacgaaaauggaagaguuuaaagaucagcucccggccgacgaauguaauaaauuaaaggaggaaaucaguaagaugcgcgaauuguuagcccgcaaagauucggaaaccggggagaacauccgccaagccgcgaguagcuugcaacaagccagcuuaaaauuauuugagauggccuauaaaaaaauggccagcgaaagggaggggagcgggucgagcgggaccggcgagcaaaaagaggaccagaaagaagagaaacaauga

SEQ ID NO: 5571 - RNA, 2028 nt, Artificial Sequence
  derived and/or modified CDS sequence (opt10) from Homo sapiens__NP_079291.2__HsHSPA12A
auggcagacaaggaagcaggggguucggacggcccucgugagacugcaccuacuucggcguacucuucgccggcucgaucguuaggugacacugggaucacgccguuaaguccgucgcacauaguaaacgauacggacaguaacguaucggagcagcagucguucuuaguaguaguagcgguggacuucgguaccacgucgucggguuacgcguacucguucacgaaagagccggagugcauacacgucaugcggaggugggaggggggagacccgggcguaaguaaccagaagacaccuacgacgauauuauuaacgccggagcggaaguuccacucguucgguuacgcggcccgugacuucuaccacgacuuagacccaaacgaggcaaagcaaugguuauacuuggagaaauucaaaaugaaguuacacacuacgggagacuuaacgauggacacugacuugacugccgcgaacgguaaaaagguaaaggcgcucgagaucuucgcguacgcauuacaguacuucaaggagcaggccuuaaaggagcucucugaccaggcugggucagaguucgagaacagugacguaagguggguaauaacuguaccggcgauauggaagcagccagcgaagcaguucaugcgccaggcagcguaccaggcgggguuagcgucgccggagaacagugagcaguuaauaaucgcuuuagaaccggaagcggcgucgauauacugccggaaguuacguuuacaccaaaugauagaguuaucaaguaaggcggcgguuaacggguacucagguucggacacuguuggggcggguuucacgcaggcgaaggagcacauccgacgaaacaggcaaucgcgcacauuccucgucgagaacguuauuggcgagauuuggagugagcuugaggagggagacaaguacguaguaguagacucgggugggggaacuguugauuuaacgguacaccaaauuaggcucccagagggucacuuaaaggagcucuacaaggccacgggugguccguacgguagucucgggguugacuacgaguucgagaaguugcucuacaagaucuucggugaggacuucauagagcaguuuaagaucaagcguccggcggcguggguagaccucaugauagcuuucgaaucgcgaaagcgcgccgcagcgccggaccgaacgaacccuuugaacaucacguuaccguucucguucauagacuacuacaagaaguuccguggacacucgguagagcacgcguuacgaaagaguaacguagacuucguaaaguggucgagucaggguaugcuucgcaugucgcccgacgcgaugaacgcguuauucaagccuacuaucgacucgauaauagaacacuugagggacuuauuccagaagccggagguaucgacgguaaaguucuuauucuuagucgggggguucgcagaggcgccguuguuacagcaggcaguucaggcggcguucggugaccagugccgaauaauaauaccccaggacguaggguuaacgaucuugaagggggcgguuuuauucggguuagacccggccguaauaaagguucgacguucacccuugacuuacggugucggcgucuuaaaccgauacguagaggggaagcacccaccggaaaaguuguuagucaaggacggaacacgauggugcacggacguauucgacaaguucauaucggccgaccaaaguguagcguuaggcgaguuaguaaagcgaucguauacgccugccaagccgucgcaauuaguaauagucaucaacaucuacaguucggagcacgacaacguaaguuuuauaacggacccgggagucaagaagugcggaacauuaagguuagacuugacggguacgucggguaccgcgguuccagcgcgccgagagauacagacgcucaugcaguucggugacacggagauaaaggcgacggcgauagacaucgcuacgucuaagucgguaaaggucgguaucgacuuucucaacuacuga

SEQ ID NO: 5572 - RNA, 2061 nt, Artificial Sequence
  derived and/or modified CDS sequence (opt10) from Homo sapiens__NP_443202.3 __HsHSPA12B
auguuagcaguacccgagaugggauuacaagguuuauacauagguucgucgcccgagcguucgccgguuccgucgccuccggggucgccacgcacgcaagagucgugcgggauagcaccuuuaacuccuucccagaguccuaagccggaaguucgugcaccgcagcaggcaucguucagugucguagucgcuauagacuucgguacaacaucgucggguuacgccuucucguucgcuucggacccggaggcaauccauaugaugcguaagugggaggguggugacccuggugucgcgcaccaaaagacgccuacgugcuuauuauuaacgccugagggggcguuccacucguucggauacacggcgcgagacuacuaccacgacuuggaccccgaggaggcucgcgacugguuauacuucgaaaaguucaaaaugaagauacacucggcgacugacuuaacguuaaagacacaacucgaggcgguuaacgggaagacaaugccggcguuagaggucuucgcgcacgcguugagguucuuccgcgagcacgcgcuccaggaguuacgagagcaaucgccgucauugccggagaaagacacgguccguugggucuuaaccgucccggcgaucuggaagcaaccggcgaaacaguucaugcgagaggcggcuuauuuagcgggguuaguaucgcgugagaacgcggagcaauuauuaauagcguuagagccggaggcggcgucaguuuacugucgaaaguugcgauugcaccaguuguuagauuuaucaggaagggcgccgggaggcgggcgauugggcgagaggcgaucgauagacucgucguuccgacaggcgcgcgagcagcuccgucguucgaggcauucgcggacguucuuaguagagucggguguuggugaguuaugggcggaaaugcaggcgggugaccguuacguagucgcugacugcgguggggggacgguagacuuaacaguucaccaguuagagcagccacacgguacguugaaagagcuuuacaaggcgucaggagggccguacggggccguagggguugauuuagcguucgagcaguugcucugccggaucuucggcgaggacuucaucgcaacauucaagcgccagcguccagcggcaugggucgacuuaacaauagcguucgaggcacguaagcggacggcaggaccgcaucgagcgggugcauuaaacauaaguuuaccguucucguucauagacuucuaccggaagcaacgcggucacaacguagagacggcgcucaggcgaaguucggucaacuucguaaaguggaguucgcaggguauguugcgcaugaguugcgaggcgaugaacgaguuauuccagccaacaguuucaggcauuauacagcacauugaggcauuauuggcgcgccccgagguacagggggucaagcucuuauucuuggucggaggauucgcggagucggcaguauuacagcacgcaguacaagcggcuuuaggugcgaggggcuuacgcguaguaguaccccacgacgucgguuugacuauauugaagggcgccguuuuauucggucaggcuccgggagucgucaggguucgacggucuccauuaacuuacggugucgguguauuaaaccguuucguccccgguaggcacccgccggagaaguuauugguacgagacggucgaagguggugcacggacguguucgagcguuucguagcagcggaacagucagucgcguuaggagaggagguaaggcguucguacuguccugcaaggccaggacagcgucgagucuuaauuaacuuguauuguugcgcagcggaggacgcacgauucauaacugacccggguguacggaagugcggugccuuaaguuuggaguuagaaccggcggacugcggucaggacacggcgggugcaccaccgggucgucgagagauccgagcagcgaugcaauucggugauacugagauaaaggugacggcgguagacguuucgacuaacaggucgguccgagcaucgaucgacuucuuaucgaauuga

SEQ ID NO: 5573 - RNA, 1416 nt, Artificial Sequence
  derived and/or modified CDS sequence (opt10) from Homo sapiens__NP_008879.3__HsHSPA13
auggcgcgcgaaaugacuauacucgggucugcggucuuaacguuacucuuagcagguuacuuagcgcagcaguaccuuccucuuccgacacccaagguaauaggaauagacuuagguacgacauacugcagugucggaguauucuucccgggaacugguaaggucaagguaauaccggacgagaacggacacaucucuaucccgucgauggucucguucacggauaacgacguuuacgucggguacgagucggucgaguuagcggacucuaacccgcagaacacgaucuacgacgcuaagcgauucaucgguaagauauucacggcggaggaguuagaggcagagauagguagguacccguucaaggucuugaacaagaacgggaugguagaguucucaguaaccucgaacgagacgaucacuguaagucccgaguacgucgguucacguuuacuauuaaaguugaaggagauggcggaggcguacuugggcaugccgguagcgaacgcaguaauaucgguccccgccgaguucgacuuaaagcaacgaaacucgacgaucgaggcggcgaacuuagcggggcuuaagauccuucgagugaucaacgagccgacggcggcggcgauggccuacggguuacacaaggccgacguauuccacgugcuugucaucgacuuaggaggugggacacucgacgucucgcuuuugaacaagcaggguggaauguucuugacgcgugcgaugucggguaacaacaaguugggugggcaggacuucaaccagcgauuauuacaguacuuguacaagcaaauuuaccagacguacgguuucgucccgucacgaaaggaagagauacaucgauuaaggcaggcagucgagaugguaaaguugaacuugacguuacaccagucggcgcaauuaagugucuuguuaacgguugaggagcaggaccguaaggagccgcacucgucggacaccgaguuaccgaaggacaaguugucgucggcugacgaccacaggguaaacucggguuucggcagggguuuaucagacaagaagucgggcgagucgcagguacucuucgagacggagaucagucgaaaguuauucgacacguuaaacgaggacuuauuccaaaagaucuuaguuccgauccagcagguuuuaaaggagggucacuuagagaagacggagauagacgagguugucuuggucggugguucgacgcgaaucccccgaaucaggcagguaauacaggaguucuucgggaaggacccaaacacgucggucgauccggacuuagcgguuguuaccgguguugcgauucaggccgggauagacggggguucguggccguuacagguaucagcgcucgagauaccgaacaagcacuugcagaagacgaacuucaacuga

SEQ ID NO: 5574 - RNA, 1530 nt, Artificial Sequence
  derived and/or modified CDS sequence (opt10) from Homo sapiens__NP_057383.2__HsHSPA14
auggccgcgauagggguccauuuaggguguacgagcgcgugcgucgcgguguacaaagacgggagagccggggucgucgccaacgacgcgggggauagggucaccccggccgucgucgccuauagcgagaacgaggaaaucgucgggcucgccgccaagcagucgcgcauccgcaacaucagcaauaccgucaugaaggucaaacaaauauuagggcgcucgaguucggauccgcaggcgcaaaaguauauagccgagucgaagugccucgugaucgaaaagaacggcaagcucagguacgagaucgacaccggggaggagaccaaguucgucaauccggaggacgucgcgcgcuuaauuuuuucgaaaaugaaggagaccgcccacagcguccucgggagcgacgccaacgacgucgucaucaccgugcccuucgacuucggggaaaaacagaagaacgccuugggggaggccgcccgcgccgccggguucaacguccucaggcucauccaugaacccagcgccgccuuguuggccuacgggaucgggcaggauaguccgaccgggaagucgaacauccucgucuuuaaauugggggggaccagucucagcuugucggugauggaggucaauucggggaucuacagagucuugagcacgaauaccgacgacaauauagggggggcccauuuuaccgagacgcucgcccaauacuuggccagcgaauuucagcgcaguuuuaagcacgacguccgcgggaacgccagggcgaugaugaagcucaccaauucggccgaggucgccaaacacagccucagcacgcucgggucggcgaauugcuuuuuggauagccucuacgaggggcaggacuucgacuguaacgucagucgcgcccgcuucgaguuguugugcagcccguuguucaacaaaugcaucgaggccauacgcggguugcucgaccagaacggguuuaccgccgacgacauaaauaaagucguguugugcgggggcagcagcaggauaccgaaauugcaacaauuaaucaaggacuuguuuccggccgucgaauuguugaacagcauaccgccggacgaggucauaccgaucggggccgccaucgaggccgggaucuugaucggcaaggagaauuuacucgucgaagauagcuugaugaucgaaugcagcgcgcgcgacauccucgucaaaggggucgaugagagcggggcgucgcgcuuuaccgucuuauucccgagcggcaccccgcucccggccaggcgccagcauacccuccaagcgccggggucgaucagcagcgucuguuuggaguuguacgaaagcgacggcaaaaauagcgcgaaagaagagacgaaauucgcccaagucgucuugcaagaucucgauaagaaggagaacgggcucagggacauccucgccgucuugaccaugaagcgcgacgggagccuccacgucaccuguaccgaccaagaaaccgggaagugcgaggccauaagcaucgaaaucgccagcuga

SEQ ID NO: 5575 - RNA, 2577 nt, Artificial Sequence
  derived and/or modified CDS sequence (opt10) from Homo sapiens__NP_006635.2 __HsHSPH1
auguccgugguaggacucgacgucgggagccaaagcugcuacauagcgguagccagggcaggcgggauagagacgaucgccaacgaguucuccgaucgcugcacacccagcgucaucagcuuugguucuaaaaacaggacuauaggaguggccgcgaaaaaccaacaaauaacccaugcaaacaacaccgucagcaacuucaaacgauuccacggacgugccuucaacgacccguuuauacaaaaagaaaaagaaaaccuauccuacgaccuagucccccucaagaauggaggcgugggcaucaaaguuauguauaugggagaagaacacuuguucucaguagaacagauaaccgccaugcuacuaacaaaacugaaggaaaccgcagagaacagucugaagaaaccugucaccgacugcguaaucuccguacccuccuucuucaccgacgcagaacggagauccguacuagacgcagcccaaauaguaggccuaaacugccuccgcuugaugaacgauaugacggccguagcacucaacuaugggauuuacaaacaagaccucccaagccucgacgaaaaaccccgcauaguagucuucgucgacaugggacacucagcauuccagguaagcgcaugcgccuucaacaaaggaaaacucaaagucuuaggcacggcuuucgaccccuuccuaggcgggaaaaauuucgacgagaaacucgucgaacacuucugcgccgaguucaaaaccaaauacaaacucgacgcaaagagcaaaauccgagcccuccuacgcuuauaccaggaaugcgaaaagcuaaagaaauugauguccuccaacuccaccgaccuacccuuaaacaucgaauguuucaugaacgacaaggacgucagcggaaagaugaacagaucccaguucgaggagcucugcgccgaguuauuacaaaagauagaagucccccucuacagccuucucgaacagacccaccucaaaguagaagacguuucagccgucgaaaucgucggcggagcaacacgcauccccgcggucaaagaacgcaucgccaaauucuucgggaaggacauauccaccacccuaaacgcagacgaagcaguggcacgcgggugugcccuccagugcgccaucuuaagccccgcauucaaaguacgagaguucucaguaaccgaugccgucccguucccaauaagccugauauggaaccacgacagcgaggacaccgaagguguccacgaagucuucagucgaaaccacgcggccccauucucaaaaguauuaacguuccuccgacgcggacccuucgaacucgaagcauucuacagcgacccgcaaggcguaccguacccugaggcaaagauuggcagguucguaguccagaacgucuccgcacaaaaagauggcgagaaaagccgcguaaaggucaaaguccgagucaauacacacggaaucuucaccauuuccaccgccucaaugguagaaaaaguccccacagaagaaaacgagaugagcucugaagccgacauggagugccucaaccaacgcccacccgaaaaccccgacaccgacaagaacguccaacaagacaacagcgaagcaggaacccagccccaaguccaaaccgacgcacaacagaccagccagagcccacccucccccgagcucacaucagaagaaaauaagaucccagacgcagacaaggccaacgaaaagaaagucgaccagcccccggaggccaagaaacccaaaaucaaaguggucaacguagaacuccccaucgaagcaaaccuggucuggcagcuagguaaagacuuauuaaacauguacaucgaaaccgaaggcaaaaugauaaugcaagauaaacucgaaaaagaacgcaacgacgccaaaaacgcagucgaagaauacguauacgaguuccgggacaaauuaugcggcccauacgaaaaauucaucugugaacaagaccaccaaaacuuucuacguuuauuaaccgaaaccgaagacuggcucuacgaagaaggcgaagaucaagcaaaacaggcuuacgucgauaaacucgaagaacuaaugaaaaucggaacgccggucaaagugcgguuccaagaagcagaagaacgucccaaaauguucgaggaacucggacaaagacuccaacacuacgcgaaaaucgccgccgacuuccgcaacaaagacgagaaguacaaccacaucgacgaaucagaaaugaagaaaguagaaaagucggucaacgaaguaauggaauggaugaacaacguaaugaacgcccaagccaaaaagucccucgaccaagacccagucguccgagcacaagaaaucaaaaccaaaauuaaggaacucaacaauaccugcgagcccgucguaacgcaaccgaaaccaaaaauagaaucccccaaacucgaacgaacccccaacgggccgaacaucgacaagaaagaagaagaccucgaggacaaaaacaacuucggagcagaaccaccacaccaaaacggcgaaugcuacccaaacgagaaaaacagcgucaacauggaccucgauuga

SEQ ID NO: 5576 - RNA, 3000 nt, Artificial Sequence
  derived and/or modified CDS sequence (opt10) from Homo sapiens__NP_006380.1 __HsHYOU1
auggccgauaagguccgccgccaacgcccccgccgcagggugugcugggcgcucgucgccgucuugcucgccgauuuacucgccuuaucggacaccuuagccgucaugagcgucgauuuagggucggaaaguaugaaagucgcgaucgugaagccgggggucccgauggagaucgugcucaacaaagagagcagacgcaagacccccgucauagucacguuaaaggagaacgagcgcuuuuucggggauucggccgccucgauggccaucaaaaacccgaaagccaccuugagguauuuucaacauuuguuaggcaaacaagccgacaauccgcacgucgccuuguaucaagcgagguuucccgaacaugaauuaaccuuugauccgcaacgccaaaccguccauuuccaaauaucgagccaauuacaauuuagcccggaagagguccucgggauggucuugaacuacagcaggagcuuggccgaggacuucgccgaacaaccgauaaaagacgccgucauaacggucccgguguuuuuuaaucaagcggaaaggagggccgucuuacaagccgccaggauggccggguugaaggucuuacaauugauaaacgauaauacggcgaccgcguugucguacgggguguuuaggagaaaggacaucaauacgaccgcgcaaaacauaauguuuuacgauauggggagcgggucgacggucuguacgaucgucacguaucaaauggucaaaaccaaagaggccggcaugcaaccgcaauuacaaauaagaggggucggguucgauaggacguuaggcggguuagaaauggaauugagauugagggagagguuagccggcuuguuuaacgaacaaaggaaagggcaacgcgccaaagacgucagagaaaaucccagggcgauggcgaaauuauuaagggaagccaacagauugaagacgguguugucggcgaaugccgaucauauggcccaaaucgagggguuaauggacgacgucgauuuuaaagccaaggucaccagggucgaguucgaagaacucugcgccgaucucuucgaaagagucccgggcccgguccaacaagcguugcaaucggcggagaugucguuagacgaaaucgaacaagucauauuagucgggggcgcgaccagagugccgcgcguccaagaagucuuauuaaaagcggucgggaaagaagaauuaggcaaaaauauaaacgccgacgaggccgcggcgaugggcgccgucuaucaagccgccgccuugucgaaggcguucaaggucaaaccguucguggugagggacgccgucguguauccgauauuagucgaauuuacccgcgaagucgaagaagaaccgggcauccauucguuaaaacauaacaagagagucuuguuuagcagaaugggcccguauccgcagaggaaggugauaacguucaauagguauucgcacgacuuuaauuuucauauaaauuauggggauuuaggguuuuuaggcccggaggacuugagagucuucgggagucaaaacuuaacgaccgucaaauugaagggcgucggggauucguuuaaaaaauacccggauuaugaaaguaaagggauaaaagcccauuuuaauuuagacgaaucgggggucuugucguuggaucgcgucgaaagcgucuucgaaaccuuagucgaagauucggccgaggaagagagcaccuugacgaaguuggggaauacgaucaguucguuauucgggggggggacgaccccggacgcgaaagaaaacgggaccgacaccgugcaagaagaggaagaaucgccggccgaaggcucgaaagaugaaccgggcgaacaagucgaauugaaagaagaggccgaagcgccggucgaagacgggagccaaccgccgccgccggagccgaaaggggacgccacgccggaaggggagaaagcgaccgagaaggagaacggcgauaaaagcgaagcgcaaaagccgucggaaaaagccgaagccggcccggaagggguggccccggcgccggaaggggaaaaaaaacaaaaaccggcgcgcaaaagaaggauggucgaagaaauaggcgucgaauuagucgucuuagauuuaccggaucucccggaagacaaauuagcccaaagcguccaaaaguugcaagaucucaccuugagggauuuagaaaaacaagagagagagaaggccgcaaauucgcucgaggccuuuaucuucgaaacgcaagauaaauuauaucaaccggaauaucaagaggucaguaccgaagaacaaagggaagaaauaagcggcaaauugucggcggccaguacgugguuagaagacgaaggggucggggcgacgaccgucaugcucaaagaaaaauuagccgaauuacgcaaauuaugucagggcuuauucuucagagucgaagaaaggaaaaaauggccggagagauuaagcgcguuggacaacuuguugaaucacaguucgauguuuuugaaaggcgcgagauugauaccggaaauggaucaaauauuuaccgaagucgaaaugaccacccucgaaaaggugauaaacgaaacgugggcguggaaaaacgccaccuuagcggaacaagccaaauuaccggcgaccgaaaaaccgguccucuugagcaaggauaucgaggccaaaaugauggcguuagauagggaaguccaauacuuauugaacaaagcgaaauucacgaaaccgagaccgagaccgaaagauaaaaacggcacgagagccgaaccgccguugaacgcgucggcgucggaucaaggcgaaaaagugauaccgccggccgggcaaaccgaggacgccgaaccgaucagcgagccggaaaaggucgaaaccgggagugaaccgggggauaccgaaccgcucgaacucggggggccgggggccgagccggagcaaaaggagcagagcaccgggcaaaaaagaccgcucaaaaaugaugaguuguga

SEQ ID NO: 5577 - RNA, 2199 nt, Artificial Sequence
  derived and/or modified CDS sequence (opt10) from Homo sapiens__NP_005339.3 __HsHSP90AA1
augccggaggagacgcaaacgcaggaucagccgauggaggaagaggagguagagacauucgcauuccaggcggagauagcacaauuaaugucguuaauaauuaacacguucuacaguaacaaggagauauucuuaagggaguuaauaucgaacucgucggacgcguuggacaaaauacgauacgaaucguuaacggacccgucgaaguuagacucggguaaggaguugcacaucaacuuaauuccgaacaagcaggaccggacguuaacgauaguagacacggguauaggaaugacgaaagcggacuugauaaacaacuuaggaacgauagcgaagucggguacuaaggcguucauggaggcauuacaggcgggugcggacauaaguaugauaggucaauucggggucggauucuacucggcauacuuagucgcagagaagguaacgguaaucacgaagcacaacgacgacgaacaauacgccugggagaguucggcgggugguaguuucacgguacgcacugacacgggugagccgauggguagggguacgaagguaauauuacacuuaaaggaggaccagacggaauacuuagaggagcgccggaucaaggagauuguuaaaaagcacucgcaauucaucggcuacccuauaacguuauucgucgagaaggagcgcgacaaggagguuagugacgacgaggcggaggagaaagaggacaaggaggaggagaaggaaaaggaggagaaggagucggaggacaagccggagauagaggacguaggaucggacgaggaggaggagaagaaggacggggacaaaaagaagaagaaaaagauaaaggagaaauacauagaccaagaggaguuaaacaagacgaagccgaucuggacaaggaacccggacgacauaacgaacgaggaguacggugaguucuacaagucguuaacaaacgacugggaggaccacuuagcggucaaacacuucaguguagaggggcaguuagaguuccgcgcguuguuauucguaccgaggcgcgcgccguucgacuuauucgagaaccggaagaagaaaaacaauauaaaguuauacguccgaaggguauucauaauggacaacugcgaggaguuaauuccggaguaccucaacuucauacgcggugucgucgacucggaagacuugccguuaaacaucucgcgagagauguuacagcagucgaagaucuuaaagguaauacgcaagaacuuagucaagaagugcuuagaguuauucacggaguuggcagaggacaaggagaauuacaaaaaauucuacgagcaguucucgaagaauauaaaguuagggauacacgaggacagucagaaccgaaaaaaguuaucagaauuauuacgauacuauacgagugcgucgggggacgaaauggucaguuugaaggacuauuguacacggaugaaggaaaaccaaaagcacauauacuacauaacgggggagacgaaggaccaaguugcgaacucggcauucgucgagcgcuuacggaagcacggguuagaggucauauacaugaucgaaccuauagacgaguauugcguacagcaauugaaggaguucgaggggaagacauuaguaaguguaacaaaggagggguuagaguugccggaggacgaggaggagaagaagaagcaggaggagaagaagacgaaguucgagaacuuaugcaagauaaugaaggacauauuagagaagaaggucgagaaggucgucgucucuaacagguugguaacgucgccgugcugcauaguaacgucgacuuacgguuggacugcgaacauggaacgaauaaugaaggcgcaggcguuaagggacaacaguacgauggguuacauggcggcaaagaagcauuuagaaaucaacccggaccacucgaucauagagacguuacgacagaaggcggaggcggacaagaacgacaagagugucaaagacuuaguaauauuauuauacgagacggcguuguuaucgaguggguucucguuagaggacccacaaacucacgcgaaccgaauauaucgcaugauaaaguugggauuaggaaucgacgaggacgacccgacggcggacgacacaucggcggccguaaccgaggagaugccgccguuagagggugacgacgauacuucgcggauggaggagguagacuga

SEQ ID NO: 5578 - RNA, 2175 nt, Artificial Sequence
  derived and/or modified CDS sequence (opt10) from Homo sapiens__NP_031381.2__HsHSP90AB1
augccggaggagguccaucauggcgaggaagagguggagacguuugcguuucaagcggaaaucgcgcaguugaugucgcucauaaucaauacguuuuauaguaauaaggagauauuuuugcgcgaacucaucagcaaugccucggaugcguuagauaaaauccgcuaugagucguugaccgauccgagcaaguuagauagcgggaaagaacucaagaucgauauaauaccgaauccgcaggagaggaccuugacguuggucgauacggggaucgggaugaccaaggcggauuugaucaauaacuuggggaccaucgcgaaaucgggcaccaaggcguuuauggaagcguugcaggccggggcggauaucucgaugauagggcaguuuggggucggguuuuauucggccuauuugguggcggagaaagucgucgucauaaccaagcauaaugaugaugagcaguaugcgugggagucgucggcggggggcucguuuaccgugcgcgccgaucauggggagccgaucgggaggggcaccaaggucauauugcauuugaaagaggaucagacggaguaucucgaggaaaggcgcgugaaagagguggugaagaagcauucgcaauuuauaggguauccgaucacguuguauuuagagaaggaacgcgagaaagagaucucggaugaugaagcggaagaggagaagggggagaaggaggaggaggauaaggaugaugaggagaaaccgaaaauagaggaugucgggucggaugaggaggaugauagcgggaaagauaaaaagaagaagaccaagaagauaaaggaaaaguauauagaucaggaggaauuaaauaagaccaagccgauauggacgcgcaauccggacgauauaacccaggaggaguauggcgaguuuuauaagagcuugaccaaugauugggaagaucauuuggccgucaaacauuuuucggucgaggggcaguuggaguuucgcgccuuguuguuuauaccgcgccgcgccccguuugauuuauuugagaauaaaaagaagaagaauaauaucaaauuguaugugaggaggguguuuaucauggauagcugugaugaguuaauaccggaguauuugaauuuuauaagaggggucgucgauagugaggauuugccguugaauauaucgagggagauguugcagcaaucgaaaaucuuaaaggucauacgcaagaauauagucaagaaauguuuggaguuguuuucggagcucgccgaagacaaggagaauuauaaaaaguuuuaugaggcguuuucgaaaaauuugaaguuagggauccaugaggauucgacgaacaggcgcagguugucggaguuguugcgcuaucauaccucgcaaucgggggaugaaaugaccucguugagugaguaugucucgagaaugaaggagacccagaaaagcaucuauuauauaacgggggaaucgaaagagcaggucgccaauagcgccuuuguggagagggucaggaaaaggggguuugagguggucuauaugaccgaaccgauagaugaauauugcguccagcaauugaaggaguuugaugggaagucguuggugagcgucacgaaggagggguuggagcucccggaggaugaggaggaaaaaaagaagauggaggagagcaaggcgaaguuugaaaaucucuguaaauuaaugaaggaaauauuggauaagaaagucgagaaagugaccauaagcaauagauuagucucgagcccguguuguauagugaccucgaccuauggguggaccgccaauauggagaggaucaugaaggcccaggcguugcgcgauaauagcacgaugggcuauaugauggcgaaaaagcauuuggagaucaauccggaucauccgaucgucgagaccuugcgccagaaagcggaggccgauaagaaugauaaggcggucaaggauuuggucguguuauuguuugagaccgcguuguugagcucgggguucagcuuagaagauccgcagacgcauucgaaucgcauauauaggaugaucaaauugggguuagggaucgaugaagaugaggucgcggccgaggaaccgaaugccgccgugccggaugagauacccccguuagagggcgaugaagaugccagccgcauggaggaaguggauuga

SEQ ID NO: 5579 - RNA, 2412 nt, Artificial Sequence
  derived and/or modified CDS sequence (opt10) from Homo sapiens__NP_003290.1__HsHSP90B1
augcgcgcguugugggucuuggguuuguguugugucuuguugacauuugggagcgugagggccgaugaugaaguggauguagaugggaccguggaggaagauuuggggaagucgagggaggggucgagaaccgacgaugaagugguacaaagggaagaggaagccauccaauuggacggguugaaugcgucgcaaaucagggaauugagagaaaaaucggagaaauucgcguuucaggcggaggugaaucgcaugaugaaguugauuauaaauaguuuguauaagaacaaggaaaucuuuuuaagagaguugauaaguaaugcgucggacgcgcucgacaaaaucagguugauaucguuaaccgaugagaacgcgcucucgggcaaugaagaguugacggucaagaucaaaugugauaaagaaaaaaauuuauugcacgucaccgauacaggggucgggaugacgagggaggaauuggugaagaauuuggggacgaucgcgaaaucggggaccucggaauuuuugaauaagaugaccgaagcgcaagaggaugggcaaagcaccucggaauugaucgggcaauuuggcgucggcuuuuauucggccuuuuuggucgccgauaaagucaucgugaccucgaagcauaauaaugacacgcaacauauuugggaaagcgauucgaaugaguucucggucauagccgaucccagagggaauaccuuggggcgcgggacgacgauaaccuuggucuugaaagaggaagccagcgauuauuuggaguuagauaccauaaagaauuuggucaaaaaguacucgcaauuuauuaauuuucccaucuauguguggucgagcaaaaccgagaccgucgaagaaccuauggaagaagaagaagccgcgaaggaggaaaaggaggagagcgacgaugaggccgccguggaagaggaggaagaggaaaagaaaccgaaaacgaaaaaggucgaaaagacggucugggauugggaguugaugaacgauauuaagccgaucuggcaaaggcccucgaaggagguggaagaggaugaauauaaggcguuuuauaaaucguuuucgaaagagucggacgauccuauggcguacauccauuucaccgcggagggggaagucaccuuuaagucgauauuguuugugccuaccucggcgccgcgcggguuguucgaugaguauggcucgaaaaaaucggauuauauaaaguuguauguaaggagagucuuuauuacggaugauuuucaugauaugaugccgaaauauuuaaauuucgugaaaggggucgucgacagcgacgauuuaccguugaacgucucgcgcgaaaccuugcaacaacauaaguuauugaaagucaucaggaaaaaauuggugcgcaagaccuuggauaugauaaaaaaaaucgccgacgacaaauauaacgauaccuuuuggaaggaauuugggacaaauauuaaguugggggucauagaggaucauucgaacaggacccgcuuggccaaguuguugcgcuuucaaucgucgcaccauccgaccgauaucaccucguuagaucaauacgucgagaggaugaaagagaagcaagauaagauauauuuuauggccgggaguucgaggaaggaagccgagucgucgccguucgucgaaagguuguugaaaaaaggguacgaggugauauaucucacggagccggucgaugaguauuguauacaagcguugccggaauuugaugggaaacgcuuucaaaacguggccaaagagggggucaaauuugaugagucggaaaaaaccaaagaaagccgcgaggccguggaaaaggaauuugaaccguuauugaauuggaugaaggauaaggcauugaaagauaaaaucgagaaagccgucgucagccaaagauuaacggaaucgccgugcgcguugguggcaucgcaauauggguggucggguaauauggaacgcauaaugaaagcccaagcguaucaaaccgggaaagauauaucgacgaauuauuaugcgucgcaaaaaaaaaccuuugagauaaauccgcgccaucccuugauucgcgauauguugaggcgcauaaaagaggaugaagacgauaaaacggucuuggauuuggcaguagucuuguuugagaccgcgaccuugcgcucgggguauuuauugccggauaccaaggcguauggggauaggauagagaggauguugcgcuugucguugaauaucgauccggacgccaaagucgaggaagaaccggaagaagaaccggaggaaaccgccgaagauacgacggaagauaccgaacaagaugaagacgaagaaauggacguagggaccgaugaggaagaggagacggccaaagagagcacggccgagaaagaugaguuguga

SEQ ID NO: 5580 - RNA, 2115 nt, Artificial Sequence
  derived and/or modified CDS sequence (opt10) from Homo sapiens__NP_057376.2__HsTRAP1
auggcgagggagcucagggcguuguuguugugggggaggagguugaggccguuguugagggcgccggccuuggcggccgugccgggggggaagccgaucuuguguccgaggcgcaccaccgcccaguuggggccgaggaggaauccggcguggagcuugcaagcggggagguuguuuaguacccagacggcggaggauaaggaggagccguugcauucgaucauaucgucgacggaaaguguccaggggucgacgaguaagcaugaauuucaagcggagacgaaaaaguuguuggauauagucgcgaggucguuguauagugagaaggagguguuuauaagggaguugauaagcaaugccagugaugccuuggagaaguugaggcauaaguuggucagcgaugggcaggccuugccggagauggagauccacuugcagacgaaugccgagaaggggacgaucaccauccaggauaccgggaucgggaugacccaagaagaguuggugagcaauuuggggaccaucgcgaggucggggucgaaggcguuuuuggaugcguugcagaaucaggcggaggcgaguaguaagauaauagggcaauuuggggucggguuuuacagugcguuuauggucgccgauaggguggaggucuacagcaggagcgccgcgccggggaguuugggguaucagugguugagugaugggucgggggucuuugagaucgccgaggcgagcggggugaggaccgggacgaagauaauaauccauuugaagucggauuguaaggaguucucgagcgaggcgagggugagggauguggugacgaaguacagcaacuuugugagcuucccguuguacuugaaugggcgcaggaugaauaccuugcaggcgauauggaugauggauccgaaggaugugagggaguggcaacacgaggaauuuuauagguaugucgcccaggcccaugauaagccgagguauacguugcauuauaagaccgaugcgccguugaauauaaggaguauauuuuauguccccgauaugaagccgucgauguuugaugucaguagggaguuggggagcagcgucgccuuguauagccgcaagguguugauccagaccaaggcgacggauauauugccgaagugguugagguuuauacgcggggugguggauucggaggauauaccguugaauuugagcagggaguuguugcaggagagugcgcucauaaggaaguugagggaugucuugcagcaaagguugaucaaguuuuuuauagaccagaguaaaaaggacgccgagaaguaugcgaaguuuuuugaggauuauggguuguuuaugagagaggggauagucaccgccacggaacaggaagugaaggaagauaucgccaaguuguugcgcuaugaaaguucggcguugccgagcgggcaguugaccucguugucggaguaugcgagcaggaugcgcgccgggacgaggaauauauauuauuugugugcgccgaauaggcauuuggccgagcauagcccguauuaugaagcgaugaagaaaaaggauacggagguguuauuuuguuucgagcaguuugaugaguuaacguuguugcauuugcgcgaauuugauaagaaaaaguugauaucgguggaaaccgauauaguggucgaucauuauaaggaggagaaguuugaagauaggucgccggcggccgaguguuugagcgagaaggagacggaggaguugauggcguggaugagaaauguguuggggagucgcgucacgaaugucaaggugaccuugcgcuuggauacgcauccggcgauggugacggucuuggagaugggggccgcgaggcauuuuuugaggaugcagcaguuggccaagacccaagaagagagggcgcaguuguugcagccgacguuggagaucaauccgaggcaugcguugaucaaaaaguugaaccaguuacgcgcgagugaaccgggguuggcgcaguuguugguggaucaaauauaugagaaugcgaugauagccgccggguuggucgaugauccgagggcgauggucgggagguugaacgaguuguuggugaaggccuuggaaaggcacuga

SEQ ID NO: 5581 - RNA, 462 nt, Artificial Sequence
  derived and/or modified CDS sequence (opt10) from Homo sapiens__NP_000609.1__HsIGF1
auggguaagaucucgucauuaccgacgcaguuguucaagugcugcuucugcgacuucuuaaagguaaagaugcacacgaugucgaguucccacuuauucuacuuggccuuaugcuuguugacguucaccuccucggcgaccgcagggccggagaccuugugcggcgcggaguuaguagacgcguuacaguucgucugcggugaccgagguuucuacuucaacaagccgacggguuacggguccucgucgcgccgugcaccgcagacgggcaucguugacgaaugcugcuuccguucuugcgaccuccgucgcuuagagauguacugcgcgccguugaagccggcgaagucggcccguucgguacgcgcgcagcggcacacggacaugccaaagacgcagaaagagguccacuuaaagaacgcgucgcguggaucggccggcaacaagaacuaccggauguga

SEQ ID NO: 5582 - RNA, 543 nt, Artificial Sequence
  derived and/or modified CDS sequence (opt10) from Homo sapiens__NP_000603.1__HsIGF2
augggcauacccauggguaagucaauguugguguuauuaaccuucuuagccuucgccucgugcugcaucgcggccuaccguccgucagagacccuaugcggcggggagcuaguagacacgcuacaguucgugugcggcgaccggggguucuacuucucgcgccccgcgucgcgcgugucccgccguucgcgcggcaucguagaggagugcugcuuccgaucaugcgacuuggccuuauuagagaccuacugcgccaccccggccaagucggagcgagacgugucgacgccgccgaccguguuaccggacaacuucccccgguaccccgucggcaaguucuuccaguacgacacguggaagcagucgacucagagacuucgucgcggguuaccggcguuguugcgugcccgacgaggccacgugcuagccaaggaguuagaggcguuccgcgaggcgaagcggcaccgcccguuaaucgcguuacccacucaggaccccgcgcacggaggcgccccgcccgagauggcgucgaaccgaaaguga

SEQ ID NO: 5583 - RNA, 639 nt, Artificial Sequence
  derived and/or modified CDS sequence (opt10) from Homo sapiens__NP_000591.1__HsIL6
augaacucguucaguacgucggcguucggccccgucgcguucucguuagguuuguuauuggucuuaccggcggcguucccagcgcccguuccaccgggugaggacucgaaggacguugcggcgccccaccgacagcccuugaccucguccgagcguaucgacaagcagauccgauacaucuuagacgguauaagugcguuacgcaaggagacgugcaacaaaucgaacaugugcgagaguucgaaggaggcguuagccgagaacaaccucaacuugccgaagauggcggagaaggacgggugcuuccagaguggguucaacgaggagacaugcuuaguaaagaucauaacgggccuccuugaguucgaggucuaccucgaguacuuacagaacagguucgagucaucggaggagcaggcacgcgcgguucaaaugucgacgaagguauugauccaguuccuccagaagaaggccaagaacuuagacgcgaucacgacgccggacccgacuaccaacgcgaguuuguuaacuaaguuacaggcgcagaaccagugguugcaggacaugaccacccacuugaucuugcggucguucaaggaguucuugcagaguucuuuaagagcguuaaggcagauguga

SEQ ID NO: 5584 - RNA, 1281 nt, Artificial Sequence
  derived and/or modified CDS sequence (opt10) from Homo sapiens__NP_002183.1__HsINHBA
augccguuauugugguuaaggggguucuuguuagcgucgugcuggaucaucgugcguucgucgccgacgcccgggucggagggucacucggccgcaccggacugcccaaguugcgcacuugccgcguuaccgaaggacguuccgaacucgcagccggagaugguugaggccgugaaaaagcacauauugaacauguuacaccuaaagaagcgaccggacguaacgcagccgguccccaaagcggcccuauuaaacgcuauacggaaguuacacguugggaagguaggcgagaacgguuacguggagaucgaggacgacaucgggcgccgcgccgagaugaacgaguuaauggagcagacgucagagaucaucaccuucgcggagucgggcacugcgcguaagacuuugcacuucgagaucucgaaggaggguucggacuuaucggugguagagcgggccgaggugugguuauucuugaaggugccgaaggcgaaccgaacgcgaaccaaggucaccauccgauuguuccagcaacagaaacacccccaggggaguuuagacaccggggaggaggccgaggagguaggucucaagggggagcgauccgagcuccucuuaucggagaagguggucgacgcgcgaaagucuacguggcacguauucccggugucgucgucgauccagcgccuacuugaccagggcaagaguucguuggacguccgcauagcgugcgagcagugccaggagucgggcgcgucucuuguauuguuagggaagaagaagaagaaggaggaggagggugaggggaagaagaaggggggcggggagggcggggcgggcgcggacgaggagaaggagcagucucaccggccguucuuaauguuacaagcgcgucaaucggaggaccacccgcaccgacgacgccgacguggguuagagugcgacggcaaggugaacaucugcugcaagaagcaguucuucguuucauucaaggacaucgguuggaacgacuggauaauagccccgucgggguaccacgcgaacuacugcgagggcgagugcccgucccacaucgccgguacuucgggcucgucguuaucguuccacaguacgguuauaaaccauuaccguaugcguggacacucccccuucgcgaacuugaagaguugcugcgugccgaccaaguugcgucccaugucgaugcuuuacuacgacgacggccagaacauuauaaagaaggacauccagaacaugaucgucgaggaaugcggcugcaguuga

SEQ ID NO: 5585 - RNA, 1224 nt, Artificial Sequence
  derived and/or modified CDS sequence (opt10) from Homo sapiens__NP_002184.2__HsINHBB
auggacgguuuaccgggacgagcuuugggugcggcuuguuuguuauuguuggcagcggguugguuaggcccggaagcguggggaucgccgacaccucccccuacuccggcggcgccaccgcccccgccaccgccggggucgccaggcgggucccaagauacuugcacaaguugcggggguuuccgacgacccgaggaauugggacgcguagacggugauuucuuggaagcuguaaagcgucauaucuuaucgcguuuacagaugcgagggcgaccgaacauaacccacgccguaccgaaggcggcgaugguuaccgcguuacgaaaguuacaugcugggaagguucgugaggacgggcguguagagaucccccauuuggacgggcacgccucgccaggggccgacgggcaagagcgagucucggagauaauuaguuucgcggagacugacggguuagcgucgucgaggguacguuuauacuucuucauaucgaacgaggguaaccaaaacuuguucguaguacaggcgaguuuaugguuauaccuuaagcuauuaccauacguuuuagagaaggggucgcgucgaaaaguaaggguaaagguauacuuccaagagcaaggucacggcgaccgauggaacaugguagagaagcggguugaccuuaagcgaaguggauggcacacguucccguuaacugaggcaauacaggcauuauucgagcguggagagcgccgcuuaaacuuagacguacaaugcgacucgugccaggaguuggcagucgucccaguauucguagaccccggggaggagagucaucgaccguucguaguaguacaggcgcgcuuaggugacucgcgacaccgaauccggaagcgugguuuagagugcgacgguaggacgaacuugugcugccgacagcaguuuuuuauagacuuuagguugaucggguggaacgacuggauaauugcgccgacaggauacuacgguaacuauugcgaaggaaguugcccggcguacuuagcgggggugccagguucggcaucgucguuccacacugcgguaguuaaccaguaccgaaugcgaggauugaauccggggacaguaaacucgugcugcaucccgacgaaguuaaguacgaugucgauguuauacuucgacgacgaguacaacauaguaaagcgcgacgucccgaacaugaucguagaagagugcgguugcgcguga

SEQ ID NO: 5586 - RNA, 3459 nt, Artificial Sequence
  derived and/or modified CDS sequence (opt10) from Homo sapiens__NP_000623.2__HsITGAM
auggcguugaggguccucuuauugaccgccuugaccuuaugccauggguuuaauuuggauacggagaacgccaugacguuucaggagaaugccaggggguuugggcagagcgucgugcaguugcaggggagcagggucguggugggggcgccgcaggaaaucguggccgccaaucagagggggagcuuguaucagugugauuauagcacgggcagcugugagccgauacgcuuacaggugccgguggaggccgugaauaugucguuaggguugucguuggcggcgaccacgagcccgccgcaguugcucgccugugggccgacggugcaccaaacguguagcgagaauacguaugucaagggguuguguuucuuguucggcaguaauuugaggcaacaaccgcagaaguuuccggaggcguugagggggugcccccaggaggauucggauaucgcguucuugaucgaugggagugggaguaucaucccgcaugauuuuaggagaaugaaagaguucgugagcaccgucauggagcaguugaaaaagaguaagaccuuguuuaguuuaaugcaguauucggaagaauuucgcauacauuuuacguuuaaggaauuucaaaauaauccgaauccgaggagcuuagucaagccgaucacccaguuguuggggcgcacccauaccgcgaccgggauacgcaaaguggucagggaguuguuuaauaucaccaacggggccaggaagaaugcguuuaagauauuggucgugaucacggauggggagaaguuuggcgauccgcucggguaugaggaugucauaccggaggccgaucgcgaaggggucauaagguaugugauaggggucggcgaugcguuuaggucggagaagaguaggcaagaguugaauaccaucgcgaguaagcccccgagggaucauguguuucaggugaauaauuuugaggcguugaagacgauacagaaucaguugagggaaaagaucuuugcgaucgaggggacgcagacggggucgaguucgaguuuugagcacgagaugagucaggagggguuuucggcggccauaacgaguaaugggccguuguugagcacgguggggagcuaugauugggccggggggguguuuuuguauacgaguaaagagaagaguaccuuuauaaauaugacgcgcguggacagcgauaugaaugaugccuacuugggguaugcggccgccauaaucuugaggaaucgcguccagagcuugguccucggggcgccgagguaucagcauauaggguuggucgccauguuuaggcagaauacgggcaugugggagucgaaugccaaugugaaagggacgcagauaggggccuauuuuggggccagcuuguguagcgucgauguggauagcaaugggucgaccgacuuggucuugauaggggccccgcauuauuacgaacaaaccaggggggggcaggucagcgugugcccguugccgagggggagggcgagguggcagugugaugccgucuuguacggggagcaggggcagccgugggggcgcuuuggggcggccuugacgguguugggggaugugaauggggauaaguugacggaugucgccauaggggccccgggggaagaggauaauaggggggccgucuauuuguuucaugggacgagugggucggggauaagcccgagucauagccagaggaucgcggggagcaaguuaaguccgcgcuuacaguauuuuggccagucguugaguggggggcaggauuugaccauggauggguuggucgacuuaaccgucggggcccagggccacgucuuguuguugaggagucagccggucuugagggugaaagccauaauggaauuuaacccgagagagguggccaggaauguguuugaguguaaugaucaggucgugaaagggaaggaggcgggggaggugcgcgucugcuuacauguccagaaaucgaccagggacagguuaagggaggggcagauacaaagugucgugacguaugauuuggcguuggauagugggcgcccgcauucgagggcgguguuuaaugagacgaagaacagcacgaggagacagacgcaagucuugggguugacgcagaccugugaaaccuugaaguugcaguuaccgaauugcauagaggauccggugagcccgauagucuugagguugaacuucaguuugguggggaccccguugagcgccuuugggaauuugaggccgguguuggcggaggaugcgcagagguuguuuacggcguuguuuccguuugagaaaaauugugggaaugauaauaucugccaggaugauuugucgauaacguuuagcuuuaugagcuuggauuguuuggucgucggggggccgagggaguucaaugugaccgugacgguccgcaaugauggggaagacaguuaucgcacccaggucaccuuuuuuuuucccuuggauuugagcuauaggaaggugagcacguugcagaaucagaggagccagaggagcuggcgcuuggccugcgagagcgcgagcagcaccgaggucucgggggcguuaaagagcacgaguugcaguaucaaucauccgauauuuccggaaaauucggaggugaccuuuaauaucaccuuugaugucgauagcaaggccagcuuggggaauaaguugcucuuaaaggcgaaugugacgucggagaauaauaugccgcgcaccaauaagaccgaauuucaguuggaguugccggugaaauacgcggucuauaugguggugacgucgcauggggucaguaccaaguauuugaauuucacggcgucggagaauaccagucgcgucaugcagcaucaguaucaagucaguaauuuggggcagaggucguugccgauaaguuuggucuuuuuggucccggugcgcuugaaucaaaccgucaucugggauaggccgcaggucaccuuuagcgagaauuugaguaguaccugccauaccaaggagagguugccgucgcacagugauuucuuggccgaauugaggaaggcgccggucgucaauuguagcauagccgucugucaaaggauccaaugugauaucccguuuuucggcauccaagaggaauuuaaugccaccuugaaggggaauuugucguuugauugguacauaaaaacgagccacaaucauuuguugaucgucaguaccgcggagauauuguuuaaugauucgguguuuacccucuuaccggggcagggggccuuugucaggagccaaaccgagaccaaggucgagccguuugaggugcccaaucccuugcccuugauaguggggaguagugucgggggcuuguuguuguuggcguugauaaccgccgccuuauacaaauugggguuuuuuaaaaggcaguauaaggacaugaugagugagggggggcccccgggcgcggagccgcaauga

SEQ ID NO: 5587 - RNA, 1404 nt, Artificial Sequence
  derived and/or modified CDS sequence (opt10) from Homo sapiens__NP_002415.1__HsMMP8
auguuuaguuuaaaaaccuugccguucuuauugcucuugcacguccaaaucaguaaagcguucccggucagcagcaaggaaaagaacaccaagaccguccaagauuauuuagagaaauuuuaucagcucccgucgaaucaauaccaaagcacccgcaaaaacgggaccaacgucauagucgagaaauugaaggagaugcaaagguucuucggccucaacgucaccggcaaaccgaacgaagagaccuuagauaugaugaagaaaccgaggugcggggucccggauucggggggguucaugcucacgccggggaauccgaaaugggagaggaccaaucucacguaucgcaucaggaauuacacgccgcaauuaagcgaagccgaagucgagcgcgccauaaaagacgcguucgaguuguggucggucgccagcccguugauauuuacgcgcauaagccaaggggaagccgacauaaauaucgccuucuaucagcgcgaccauggggauaacagcccguucgacgggccgaacgggauauuggcccacgcguuccaaccggggcaggggaucgggggggacgcccacuucgacgcggaggagaccuggacgaauacgagugccaacuauaaucucuucuuggucgccgcccacgaguucgggcacagccucggcuuggcccauaguagcgauccgggggcgcucauguacccgaauuacgccuuucgcgagacgucgaauuauagcuugccgcaggacgauauagacgggauccaagcgauauacggguugagcucgaauccgauacagccgaccgggccgucgaccccgaagccgugcgauccgucgcucaccuucgacgccauaacgaccuugaggggggagaucuuguuuuucaaggaucgcuauuuuuggcgccgccacccgcaauugcagcgcguggagaugaacuucaucagcuuguuuuggccgaguuugccgaccgggauccaagccgccuacgaggacuucgaucgcgauuugaucuuuuuguucaaggggaaucaguauugggccuuaucgggguacgacaucuuacagggguacccgaaagacaucagcaauuacggguuuccgucgucggugcaggccaucgaugccgccgucuuuuaucgcucgaagaccuauuuuuucgucaacgaucaguuuuggcgcuacgacaaucagcgccaguuuauggaaccgggguacccgaagucgaucagcggggcguucccggggaucgaaucgaaggucgacgccgucuuucaacaggagcacuuuuuucacguguuuucggggccgcgcuacuaugccuucgacuugaucgcccaacgcgucacgcgcgucgcccgcgggaacaagugguugaauugccgcuacggguga

SEQ ID NO: 5588 - RNA, 2124 nt, Artificial Sequence
  derived and/or modified CDS sequence (opt10) from Homo sapiens__NP_004985.2__HsMMP9
augucguuauggcaaccuuugguauugguauuauuggucuuagggugcugcuucgcagcgccgcgucagcgacagucgacauuagucuuguucccgggugacuuacgaaccaacuuaacugaucggcaauuagcugaagaguauuuauacagguacggcuacacgcgcguagcggagaugaggggggagucuaagaguuuaggcccagcauuacucuuguugcagaaacaguuaucguuacccgaaacgggggaauuagacucggcgacacucaaggcgaugcgcacuccucguugcggaguacccgacuugggacgauuucagacauucgagggugauuugaaguggcaccaccacaacauaacguacuggauccagaacuacucugaggacuuaccucgugcaguaauagacgacgcuuucgcacgagcguucgcuuuauggucggccguuacacccuugacguuuacgcgagucuauucgcgcgacgccgacauaguaauacaguucgggguagccgagcacggugacggcuacccauucgacgguaaggacgguuuauuagcgcacgcguucccgccggggccggguauccagggcgacgcgcacuucgacgacgacgaauuauggucuuuagggaaagggguaguuguaccuacgcguuucgguaacgcggacggugccgcaugccauuucccguucauauucgaggggcgaucauauagugcgugcacuacggacggacggucggacggguuacccugguguucgacuacugcgaacuacgacacggacgaccgauucgguuucugcccgucggagcguuuauacacgcaagacgguaacgcggacggcaagccuugccaguucccuuucauauuccagggacagucguacucggcaugcacaaccgacgggcggucggacggguaccgguggugcgcgacuacggcgaacuacgaucgcgacaaguuauucggguucugcccaacacgggcagacucuaccguaaugggagggaacagugccggagaguugugcguauuccccuucacguucuugggaaaagaguacucaacaugcacuucggaaggccggggugacggucgauuguggugcgccacuacgaguaacuucgacucggacaaaaagugggguuucuguccugaccagggcuauucguuauucuuaguagcagcacacgaguucgggcacgcauuaggauuggaccacaguaguguacccgaagcauugauguauccgauguaccgauuuacggaagguccgccguuacacaaggacgacguaaacgguauccgacacuuauacggcccacggccggagccggaaccgcgcccaccgaccacaacgacuccacagcccacugcaccgcccacaguauguccuacggguccuccgacaguacacccgucggagcgaccgacggcaggucccacuggaccgccgagugcagggccgacggggccgccgaccgcagguccgucgacggcgacaacggucccguuaucgcccguagacgacgcgugcaacguuaacauauucgacgcaauagcagagauagguaaccaguuauacuuauucaaggacggcaaguacuggcgcuuuucggaggggcgaggaagucgaccccaggggccguucuuaaucgcggacaaguggccggcauuaccucgaaaguuagauucaguauucgaggagcgauuaaguaagaaauuauucuucuucucggguaggcaaguauggguauauacgggugccuccguauuagggccccggaggcucgacaaguuggggcucggugcugacgucgcgcagguaacgggugcuuuacgcucgggucgaggaaagauguuauuauucaguggucgccgauuauggcguuucgacguaaaggcacagauggucgacccucgaucggcgucggaggucgaccguauguucccggguguaccguuagacacacacgacguauuccaguaccgcgaaaaggcuuacuucugccaggauagguucuacuggcgagucucgucgaggucggaauuaaaucaaguagaccagguaggguaugucacguacgacaucuuacagugcccggaggacuga

SEQ ID NO: 5589 - RNA, 1416 nt, Artificial Sequence
  derived and/or modified CDS sequence (opt10) from Homo sapiens__NP_002418.1__HsMMP13
augcacccgggcguguuagccgcguuuuuguuucucucguggacccacugcagagcguuaccguugccgucggggggggacgaggacgaccucagcgaagaggauuugcaauucgccgaaagguauuuacgcagcuauuaucacccgaccaacuuggccgggauauuaaaagaaaacgccgccucgaguaugaccgaacgcuugagggagaugcaaaguuuuuuugggcucgaagucaccgggaaguuggaugacaauacgcucgacgugaugaagaaaccgcgcuguggcgucccggacgucggggaguauaacgucuuuccgaggaccuugaaguggaguaagaugaaccucacguaucgcaucgucaacuauacgccggacaugacccacagcgagguggagaaagccuuuaagaaggcguuuaaggucuggagugacgucaccccguuaaacuucacgcgcuugcaugacgggaucgccgauauaaugauuagcuucgggaucaaagaacacggggauuuuuauccguucgacggcccgagcggguuauuagcccacgccuucccgccgggcccgaacuacgggggggacgcgcacuucgacgacgacgagacguggaccucgucgaguaagggguauaaucucuucuuggucgccgcccacgaauuugggcauagucucggguuggaucauaguaaagauccgggggccuugauguucccgauauauacguauacggggaagucgcauuucauguugccggacgaugacguccagggcauacaaaguuuguacgggccgggggacgaggauccgaauccgaagcacccgaagaccccggauaagugcgauccgagucucaguuuggacgcgaucacgucguugaggggggagaccaugauauucaaggaucgcuuuuuuuggagguuacacccgcaacaagucgacgccgaauuauuccucaccaagagcuucuggccggaguugccgaauaggaucgacgccgccuacgaacauccgagccacgauuugauauuuauauuucgcgggcgcaaguucugggccuugaacggguacgauaucuuagagggguacccgaagaagaucagcgaguuaggguugccgaaggaggucaaaaaaaucucggccgccguccauuucgaagacaccgggaaaaccuuguuauuuagcgggaaucaaguguggcgcuacgacgacaccaaucacaucauggacaaggauuacccccgcuugaucgaggaggauuuuccggggaucggggacaaggucgacgccguguacgaaaagaacggguacauauacuucuuuaaugggccgauccaauucgaguauucgauauggucgaauaggaucgucagggugaugccggccaacaguauccucuggugcuga

SEQ ID NO: 5590 - RNA, 1068 nt, Artificial Sequence
  derived and/or modified CDS sequence (opt10) from Homo sapiens__NP_001286.1__HsCCR1
auggaaaccccgaacaccaccgaagauuacgacaccacaaccgaguucgacuacggcgacgccacccccugccaaaaagucaacgaacgcgccuucggcgcccaacuccucccaccccuuuacucccucgucuucgucaucggccucgucggcaauauccucguaguccucguccucguccaauacaaacgacucaaaaacaugaccuccaucuacuuacucaacuuagccaucuccgaccuccucuuccucuucacccuccccuucuggauagacuacaaacucaaagacgacugggucuucggcgacgccaugugcaaaauccucucgggcuucuacuacacaggacucuacuccgaaaucuucuucaucauccucuuaacuaucgaccgcuaccuagccaucguccacgccgucuucgcacuacgcgcccgcaccguaaccuucggcgucaucaccucaaucaucaucugggcccucgccauccucgccuccaugcccggccucuacuucucaaaaacccaaugggaguucacacaccacacaugcucacuccacuucccccacgaauccuuacgcgaauggaaacucuuccaagcccucaaacucaaccuauucggccuaguccucccacuacucgucaugaucaucugcuacacaggcaucaucaaaauacuccuccgccgccccaacgaaaagaaauccaaagcaguccgccucaucuuugucauaaugauaaucuucuuccuauucuggacccccuacaaccucaccauccucaucucaguauuccaagacuuccucuucacccaugaaugcgaacaaucacgccacuuagaccucgccguccaagucaccgaggucauugccuacacccacugcugcgucaacccaguaaucuacgccuucgucggcgaacgcuuccgcaaauaccuccgucaacuauuccaccgacgcgucgccguacaccucgucaaauggcuccccuuccuaucugucgaccgauuagaacgcgucuccuccacaagcccaagcaccggcgaacacgaacucuccgccggcuucuga

SEQ ID NO: 5591 - RNA, 636 nt, Artificial Sequence
  derived and/or modified CDS sequence (opt10) from Homo sapiens__NP_002598.4__HsPDGFA
augcgaacauuagcaugcuuguuguuauuagguugcggguacuuagcgcacguguuagcagaggaggcagagaucccgcgugagguuaucgagcgcuuggcacgaucgcagauccacaguauccgagacuuacagcgguuguuggagaucgacucagucggcucggaggacucguuagacacgaguuuacgagcgcacggggugcacgccacgaagcacguaccggagaagcgcccguugccgauacgucgcaagcgaucgaucgaggaggcggugcccgcgguuugcaagacgcgaaccgucaucuacgagaucccacgaucgcagguagacccuaccucggcuaacuucuuaauauggccuccaugcguagaggucaagcguugcacggggugcugcaacacaucgucgguuaagugccagccgucgcgagugcaccaccguucgguaaagguggccaagguugaguacguacgaaagaagcccaagcuaaaggagguucagguucgauuggaggagcacuuagagugcgcuugcgccacgacgaguuugaaccccgacuaccgugaggaggacacggggcgaccgcgcgagucgggcaagaagcgaaagcgaaagcgguugaagccgacguga

SEQ ID NO: 5592 - RNA, 726 nt, Artificial Sequence
  derived and/or modified CDS sequence (opt10) from Homo sapiens__NP_002599.1__HsPDGFB
augaaccguugcugggcccuuuucuugucguuaugcugcuacuugcgcuuggugucggccgagggugauccgauaccggaggagcuguacgagaugcuaucugaccacaguauaaggucauucgacgacuugcagcgauuauuacacggggacccgggugaagaggacggggcggaguuagacuuaaacaugacgcgcucgcacucggguggggaguuggagucguuagcgcgggggcggcgaucguuagggucguugacgaucgcggagccugcgaugaucgcggagugcaagacgcguacggaggucuucgagauaucgcgacguuuaaucgaccgaaccaacgcaaacuucuuaguauggcccccuugcgucgagguacagaggugcaguggaugcugcaacaaccgaaacguccagugcaggccgacgcagguucaguugcguccgguacaaguccguaagaucgagaucguccguaagaagccgauauucaagaaggcuacgguaaccuuagaggaccaucucgccugcaagugcgagacugucgccgcggcgaggccgguaacucggucgcccggugggagucaggagcagcgugcgaagacgccgcagacgcgaguuaccauaaggaccguacgugugcgucguccgccgaaaggaaagcaccgaaaguucaagcacacgcacgacaagacugccuuaaaggagacguuaggugccuga

SEQ ID NO: 5593 - RNA, 1038 nt, Artificial Sequence
  derived and/or modified CDS sequence (opt10) from Homo sapiens__NP_057289.1__HsPDGFC
augucguuauucggcuuguuauuauugacgagugcguuagcagggcagcggcaagguacacaggcagagucgaaccucucgucgaaguuccaguucucgucgaacaaggagcagaacggugugcaggacccacagcacgagcguaucaucacgguuucgacaaacgggucgauacacucgccgcguuucccacacacguacccgcgaaacacuguguuagucuggcgucucguugccgucgaggagaacguuuggauccaguuaacuuucgacgagagguucgguuuagaggacccggaggacgacaucugcaaguacgacuucguugagguagaggagccuucagacgguacgaucuugggacgauggugcgggucggggaccguucccgggaagcagauaucgaaggggaaccagauacgaauccgauucgucucggacgaguacuucccgucggagccggguuucugcauacacuacaacauaguaaugccgcaguucacggaggccguuucgccgucugucuuaccgcccucggcguuaccguuagacuuacucaacaacgcgaucacggcguucucuacguuagaggacuuaauacguuacuuagagccggagcgauggcaauuagacuuggaggacuuguaccgccccaccuggcaguuacucgguaaggcauucguauucgggcgaaagagucgaguaguagacuuaaauuuauuaaccgaggagguucgacuauacucuugcacuccccgcaacuucucgguuucgauccgagaggagcuuaagcgcacggacacgauauucuggccggggugcuuauuggucaagaggugcggggguaacugcgcgugcugccuucacaacugcaacgagugccagugcgugccgucgaaggucacaaagaaguaccacgaggucuuacaacuucgccccaagacgggcgugcgagguuuacacaagagucuaacugacguagcgcucgagcaccacgaggagugcgacugcgucugcagggggucgaccgggggguga

SEQ ID NO: 5594 - RNA, 1095 nt, Artificial Sequence
  derived and/or modified CDS sequence (opt10) from Homo sapiens__NP_149126.1__HsPDGFD
augcaccgacuaaucuucguauacaccuugauaugcgccaacuucugcuccugccgagacacgucggccacuccccagucggcuaguauaaaggcccuucguaacgcgaacuugcgucgggacgaccuuuacaggagggacgagacuauccaggucaagggcaacggauacguccaaucgccccgguuccccaacaguuacccgcggaacuuacuuuugaccuggcguuuacacucgcaggagaacacgaggauccaauuaguuuucgacaaccaguucggccucgaggaggccgagaacgacauaugccgauacgacuucguagagguagaggacaucagugagaccucgacgauaaucagggggcgguggugcggccacaaggagguacccccucgaaucaagagucgaaccaaccagaucaagauaaccuucaagucggacgacuacuucguagcaaagccgggguucaagauauacuacucgcucuuagaggacuuccagccggcggccgcgucggagacaaacugggagucgguaacgucgucgauaucgggugugucguacaacucacccucggucaccgacccgaccuugauagccgacgcguuagacaagaagaucgccgaguucgacacgguagaggacuuguugaaguacuucaacccggagucguggcaggaggacuuagagaacauguacuuagacacgccgagguacagggggcggucguaccacgaccgcaagucgaagguggacuuagaccgacuuaacgacgacgcgaagcgauacucgugcacaccucgaaacuacaguguaaacaucagggaggaguuaaaguuagccaacgucguauucuucccgcggugcuuauuaguucagcguugcgggggcaacugcgguugcgggacggugaacuggcgaucuugcacgugcaacucggguaagaccguaaagaaguaccacgagguccuucaguucgagcccgggcacauaaagcgucgcggccgugcgaagaccauggcgcucguggacauucaacucgaccaccacgagcguugcgacugcaucugcucgucgcgaccuccgcguuga

SEQ ID NO: 5595 - RNA, 678 nt, Artificial Sequence
  derived and/or modified CDS sequence (opt10) from Homo sapiens__NP_003946.3__HsSOCS3
augguaacgcacucgaaguucccggcggcggguaugaguaggccguuagacacaucgcuucguuuaaagacauucucgucgaagagugaauaccagcucguugucaacgcgguccggaaguugcaagaaucagguuucuauuggucggcgguaacggggggggaggcaaauuuauuauugucggcggagccagcggggacauucuuaauccgugacucgucugaccagcggcacuuuuuuacauuaucagugaagacacaaucggguacgaagaaccuucgaauacagugcgagggcggaaguuucucguugcagagugacccgcgaucuacacagccggucccucgauucgacugcguauuaaaguugguucaccauuacaugcccccaccgggggcuccgaguuucccgucaccgccgacggagccgaguucggagguaccggagcagccaucggcgcagccuuuaccggguucgccgccucgacgcgcguacuacauauacucggggggugaaaagauuccacucguauuaucgaggccuuuaucgucgaacguagcgacacuccaacacuugugccgcaagaccguuaacggacauuuagacucguacgagaaggucacgcaacucccaggcccgaucagggaguucuuggaccaguacgacgcuccauuauga

SEQ ID NO: 5596 - RNA, 483 nt, Artificial Sequence
  derived and/or modified CDS sequence (opt10) from Homo sapiens__NP_003227.1__HsTGFA
auggugccgagcgccgggcaauuggcguuauuugccuuagggaucguccucgccgccugucaagcgcucgaaaauucgaccagucccuuaucggccgaucccccggucgccgccgccgucgucagucacuucaacgauuguccggacagucauacccaauuuuguuuucacgggacgugucgcuuccucguccaagaagauaaaccggccugcgugugucacagcggcuaugucggggccaggugcgaacacgccgauuuguuagcggucgucgccgcgucgcaaaaaaaacaagcgauaacggcgcucgucgucgugaguauagucgcguuagccguguugauaauaaccugcgucuuaauccauuguugucaagugaggaagcauugcgaaugguguagagcguugauauguagacaugaaaaaccgucggcguuguuaaaagggcgcacggccuguugucauagcgagaccgucguguga

SEQ ID NO: 5597 - RNA, 1173 nt, Artificial Sequence
  derived and/or modified CDS sequence (opt10) from Homo sapiens__NP_000651.3__HsTGFB1
augcccccgucugguuuacgauuauuacccuuauuguuacccuuauugugguuauuaguauugacccccgggcgaccggccgccggcuuaaguacgugcaagaccaucgacauggaguuaguaaagcggaagcgaauagaggcgauacgagggcagaucuuaucgaaguuacgauuagccaguccgcccucgcagggcgagguaccgcccgggcccuugcccgaggccguauuagcguuauacaacaguacccgagaccgaguagcgggugagucugcggagcccgagcccgagcccgaggccgacuacuacgccaaggagguaacacgaguauugaugguagagacccacaacgagaucuacgacaaguucaagcagaguacgcacucuaucuacauguucuucaacacgagugaguuacgagaggcgguucccgagcccguauuauuaagucgagcggaguuacgauuauugcgauuaaaguuaaagguagagcagcacguagaguuauaccagaaguacaguaacaacucuuggcgauacuuaucaaaccguuuauuagcgccgucugacagucccgagugguuaucuuucgacguaacggggguaguacgacagugguuaagucgugggggcgagauagagggguuccgauugucagcgcacugcaguugcgacucucgggacaacacguugcagguagacaucaacggcuucacgacggggcgacgaggcgacuuagccaccauacacggcaugaaccgacccuucuuauuauuaauggccacgcccuuagagcgugcgcagcacuuacagucuagucgacaccgacgagccuuagacaccaacuacugcuucaguucgaccgagaagaacugcugcguacgacaguuauacaucgacuuccgaaaggacuuaggguggaaguggauacacgagccgaagggcuaccacgcgaacuucugcuuagggcccugccccuacaucuggucguuagacacgcaguacaguaagguauuagccuuauacaaccagcacaaccccggcgccucggcggccccgugcugcguaccgcaggcguuggagcccuuacccauaguauacuacguaggccguaagccgaagguagagcaguuaaguaacaugauaguacgaucgugcaagugcaguuga

SEQ ID NO: 5598 - RNA, 1245 nt, Artificial Sequence
  derived and/or modified CDS sequence (opt10) from Homo sapiens__NP_003229.1__HsTGFB2
augcacuacugcguauuaucugcguucuugauauuacacuuaguuaccguggcauugaguuuauccacuugcaguacguuagacauggaccaguucaugcgaaagcgaauagaggcuauaaggggucagauuuugucgaagcucaaguuaacgucuccuccggaggacuaccccgagccggaagagguaccgccggagguaaucaguauauacaacucgacgcgagaccuuuuacaggaaaaggcaucgcgacgcgcagcggcgugcgagagggagcguucggacgaggaguacuacgcgaaggaaguauacaagaucgacaugccuccguucuucccgucggagaacgcgaucccaccuacguucuaucgaccguacuuccgcaucgucagguucgacguaagugcgauggagaagaacgccucuaacuuaguaaaggcggaguuucgaguauucagguuacagaacccgaaggcgcgaguucccgagcagaggaucgaguuauaccagaucuuaaagaguaaggaccuuacuucgccuacgcaacgauacauagacaguaagguaguaaagacgcgagccgagggagagugguuaucguucgacgucacggacgcgguccacgagugguuacaccacaaggaccgcaaccuuggcuucaagaucagucuccacugcccgugcugcacauucgucccuucgaacaacuauauaauaccgaacaagucggaggaguuagaggcucguuucgcgggaaucgacgggacgucgacguacacgucgggagaccagaagacgaucaagucgacgcgaaagaagaacucgggaaagacaccgcacuuguuauuaauguuguuaccgucguacagguuagagucgcagcagacgaaccgccgaaagaagcgagcgcuagacgcagcguacuguuuccgaaacguacaagacaacugcuguuuaaggcccuuauacaucgacuucaagcgcgacuuggguuggaaguggauccacgagccuaaggguuauaacgcaaacuucugcgcaggcgcgugccccuaccucuggucgucggacacccaacacagucgaguguuaucucuuuacaacacgaucaaccccgaggcgagugccucgccgugcugcgucucgcaggacuuggagccauuaacgaucuuguacuacaucgguaagacgccuaagaucgagcaguuaucgaacaugauagucaaaaguugcaagugcucauga

SEQ ID NO: 5599 - RNA, 1239 nt, Artificial Sequence
  derived and/or modified CDS sequence (opt10) from Homo sapiens__NP_003230.1__HsTGFB3
augaagaugcacuugcagagggcguugguaguauuagcguuauugaacuucgcgacgguaucguuaaguuuaucgacaugcacgacguuggacuucggccacaucaagaagaagcgcguagaggcgauacggggucagauauuaaguaaguuacgcuugacgucgccgccggagccgacgguaaugacacacguaccguaccagguauuagcguuauacaacaguacgagggaguuguuagaggagaugcacggugagcgcgaggaggguugcacgcaggagaacacggagucggaguacuacgcgaaggagauacacaaguucgacaugauacaggguuuagcggagcacaacgaguuggcgguaugccccaaggggauaacgaguaaggucuucagguucaacguaucgaguguagagaagaaccgcacgaacuuauucagggcggaguuccgaguauuaagggucccgaacccgucgaguaagcgaaacgagcagaggauagaguuauuccagauauuacgccccgacgagcacauagcgaagcagcgguacauaggggguaagaacuuacccacgcgcgguacggcugagugguugucguucgacguaacagacacgguaagggagugguuauuacgcagggagaguaacuugggcuuagagauaucgauacacugcccuugccacacguuccagccgaacggggacauauuagagaacauacacgagguaauggagauaaaguucaaggguguagacaacgaggacgaccacgggcgaggggacuuggggagguuaaagaagcagaaggaccaccacaacccccacuuaauauugaugaugauaccgccgcaccgauuagacaaccccggucagggggggcagcgaaagaagagggcguuagacacgaacuacugcuuccgaaacuuggaggagaacugcugcguaaggccguuauacauagacuuccgccaggacuuaggguggaaguggguacacgagccgaaggguuacuacgcuaacuucugcagugguccgugccccuacuugaggucggcagacacaacgcacaguacgguauuagguuuauacaacacguugaacccggaggcgucggcuaguccgugcugcguaccgcaggacuuagagcccuuaacaauauuguacuacguagggagaacgccgaagguagagcaguuaucgaacaugguaguaaagucgugcaagugcaguuga

SEQ ID NO: 5600 - RNA, 1386 nt, Artificial Sequence
  derived and/or modified CDS sequence (opt10) from Homo sapiens__NP_001057.1__HsTNFRSF1B
auggccccgguggcggucugggcggcuuuagcgguagggcuugagcuuugggcggccgcgcacgcguuaccggcgcaggucgcguucacgcccuacgcucccgagccggguucaacgugcagguugcgcgaguacuacgaccaaacugcgcagaugugcugcucgaagugcuccccgggacagcacgcgaagguauucugcaccaaaacaucagacacggugugcgacucgugcgaggacucgacuuacacgcaauuauggaacugggugcccgagugccucucgugcggaucgcgaugcucgucagaccaaguagagacccaggccugcacgcgcgagcaaaaccggaucugcacgugccgcccgggcugguacugcgccuugucgaagcaggaggguugccgacucugcgcgccccuccgaaagugccggccggguuucgggguagcgcgaccugggacggagacgucggacguagucugcaagccgugcgcgcccggaacauucucuaacacgacaucgucuaccgacaucugccgcccgcaccagaucugcaacgucguugcaaucccggggaacgcgaguauggacgcgguaugcacaucgacgucgccgacgcgcucaauggcgccgggcgccgugcaccuuccgcagcccguaucgacgcggucgcagcacacccaaccgacgccggagccgucgaccgcgccgucgacuucguuccuuuuacccauggggcccucgccgcccgcggagggcucgaccggugacuucgcguugccgguaggguuaaucgugggcgucacggcguuaggguuguuaaucaucggcgucguaaacugcgugauaaugacgcagguaaagaagaagccgcugugcuugcagcgagaggcgaaggugccgcacuuaccggccgacaaggcccguggcacgcagggucccgagcagcagcacuuauuaauuaccgcgccgucgucgaguucgaguucguuggagucgagcgcaucggcccuagacaggcgagcccccacgcgaaaccagccgcaggcgccggguguggaggcgucuggggccggcgaggcccgugccucgaccggaucgucggacucgucgccgggcggacacgguacacagguaaacguaacuugcaucguuaacguaugcucgucgucggaccacucgagucagugcucgagucaggcgucgucgacgaugggggacacugacucgucgcccucagagaguccuaaggacgagcaggucccguucucgaaggaggagugcgccuuccguagucaacucgagacaccggagacgcuccucggaucaacggaggagaagccguuacccuuaggcguuccggacgcggggaugaagccgucguga

SEQ ID NO: 5601 - RNA, 513 nt, Artificial Sequence
  derived and/or modified CDS sequence (opt10) from Homo sapiens__NP_002623.2__HsPGF
augcccguaaugcgcuuauuuccauguuucuugcaguuauuagcgggcuuggccuuacccgcaguaccaccgcaacaaugggcucucucggcagggaacgguaguucggaaguugaggucgucccguuccaggaggucuggggucgaaguuacugcagggcccuugagcgccucguggacguaguaagugaguauccgagugagguagagcauauguucucgccuaguugcguuucuuuauugagguguacagguugcugcggugacgagaacuuacacugcguacccguagagaccgccaacguaacuaugcaauuauugaagauucgaucgggagaccguccaucguacguagaguuaaccuuuagucagcauguccguugcgagugccguccgcuucgcgagaaaaugaagcccgagcgucgaaggccuaaagggcgcgggaagcggcgcagggagaaacagcgaccuacggacugucacuugugcggggacgcggucccgcgacgcuga

SEQ ID NO: 5602 - RNA, 1239 nt, Artificial Sequence
  derived and/or modified CDS sequence (opt10) from Homo sapiens__NP_001020537.2__HsVEGFA
augaccgaccgccagaccgacacggcccccucgccguccuaccaccucuuacccggccggcgccggaccguggacgccgcggccucgcgcgggcagggccccgagcccgcccccgggggcggggucgagggcgugggcgcccgcgggguggccuuaaaguuauucguccagcucuuaggcugcucccgguucgggggcgcgguggugcgggccggggaggccgagcccucgggcgccgcgcgcuccgccucguccggccgggaggagccccagcccgaggagggggaggaggaggaggagaaggaggaggagcgcggcccgcaguggcgguuaggggcccgcaagcccggcucguggaccggcgaggccgccgucugcgcggacuccgcccccgccgcccgggccccgcaggcgcucgcccgcgccucggggcggggcgggcgcguggcccggcgcggcgccgaggaguccgggccgccccacucgcccucccggcgcggcucggcgucccgggccggccccgggcgcgccucggagaccaugaacuucuuauuauccugggugcacuggucgcucgccuuauuacucuacuuacaccacgccaaguggucccaggcggccccgauggccgagggcgggggccagaaccaccacgaggucgugaaguucauggacguguaccagcgcucguacugccaccccaucgagacguuagucgacaucuuccaggaguaccccgacgagaucgaguacaucuucaagcccucgugcgugccgcucaugcggugcgggggcugcugcaacgacgagggcuuagagugcgugcccaccgaggaguccaacaucaccaugcagaucaugcgcaucaagccccaccaggggcagcacaucggcgagaugucguucuuacagcacaacaagugcgagugccggcccaagaaggaccgcgcccggcaggagaagaaguccguccgcgggaagggcaaggggcagaagcggaagcgcaagaagucccgguacaagucguggucgguguacgugggcgcgcgcugcugccucaugccgugguccuuacccggcccccaccccugcgggccgugcucggagcggcgcaagcacuuauucguccaggacccgcagacgugcaagugcucgugcaagaacacggacucgcggugcaaggcgcgccagcucgaguuaaacgagcggacgugccgcugcgacaagccgcggcgcuga

SEQ ID NO: 5603 - RNA, 699 nt, Artificial Sequence
  derived and/or modified CDS sequence (opt10) from Homo sapiens__NP_001165094.1__HsVEGFA
augaacuucuuauugucguggguccacuggaguuuagcguuauuguuauacuuacaccacgcgaaguggucgcaagcagcgccgauggcggagggggguggucaaaaccaccacgagguaguaaaguucauggacguguaccagaggucguacugccacccgauagagacguugguagacauauuccaagaguacccggacgagaucgaguacaucuucaagccgucgugcguaccguuaaugcgcugcggugguugcugcaacgacgaggguuuagagugcgucccuacggaggagaguaacaucacuaugcagauaaugaggauuaagccgcaucaagggcagcacauaggggagaugucguucuugcagcauaacaagugcgagugccgaccgaagaaggaccgagcgcgacaggagaagaagaguguaagggguaaagggaagggucaaaagcgcaagaggaaaaagagucgauacaagucguggucgguauacgucggggccaggugcugcuuaaugccguggucguuaccagggccgcacccgugcgggccgugcucggagcgcaggaagcacuuauucguacaggacccacagacgugcaagugcaguugcaagaacacggacucgcguugcaaggcacgacaguuagaguuaaacgagcgaacgugccggugcgacaagccucgaagguga

SEQ ID NO: 5604 - RNA, 624 nt, Artificial Sequence
  derived and/or modified CDS sequence (opt10) from Homo sapiens__NP_003368.1__HsVEGFB
augucgccguuauugaggagguuauuauuggcggccuuguuacaauuagcgccggcgcaagcgccggugagucaaccggacgcgccggggcaucaacgcaaggucgucagcuggaucgacgucuacaccagggccacgugucaaccgagagaagucgucgucccgcucaccgucgaauugauggggacggucgcgaagcaauuagucccgucgugugucaccguccaaaggugcgggggguguuguccggaugacggguuagaaugcgucccgaccggccaacaucaggugagaaugcaaauauugaugauaagauaucccucgucgcaauuaggcgaaaugaguuuagaggagcauucgcaaugcgagugucgcccgaagaagaaagauucggccgucaaaccggaucgcgccgcgaccccgcaucauaggccgcaaccgaggagcguccccgggugggauagcgcgccgggggccccgaguccggccgauauaacgcacccgaccccggcgccggggccgagcgcgcaugccgccccgucgacgacgucggcguuaacgccggggccggcggccgcggccgcggaugcggccgccaguagugucgcgaaagggggcgccuga

SEQ ID NO: 5605 - RNA, 1260 nt, Artificial Sequence
  derived and/or modified CDS sequence (opt10) from Homo sapiens__NP_005420.1__HsVEGFC
augcaccucuuaggguucuucagcgucgccugcuccuuacuggcggcggcccuccugcccgggccgcgcgaggccccggcggcggcggcggcguucgagagcggccuggaccucuccgacgccgagccggacgcgggggaggcgaccgccuacgccucgaaggacuuagaggagcagcugcgguccgucagcuccguggacgagcucaugaccgugcuguaccccgaguacuggaagauguacaagugccaguugcgcaagggcggguggcagcacaaccgggagcaggcgaaccucaacagccgcacggaggagaccaucaaguucgcggccgcccacuacaacaccgagauccucaaguccaucgacaacgaguggcggaagacccagugcaugccgcgcgaagucugcaucgacgucggcaaagaguucggcguggccacgaauacguuuuucaagccgcccugcgucaguguguaucggugcgggggcuguuguaacuccgaaggguuacaauguaugaauacgucgaccucguauuuaucgaaaacgcuguucgagaucaccguccccuugucccaggggccgaagcccgucaccauaucguucgcgaaccauaccucgugucgcuguaugagcaaguuagacguguaucgccaggugcacucgaucauccggcggaguuuacccgcgacguugccccaaugccaagccgccaauaaaacguguccgacgaacuauauguggaacaaccauauaugucgcuguuuagcccaagaggacuucauguucaguuccgacgccggggacgauagcaccgacggcuuucacgauauaugcggccccaauaaagaauuagacgaggaaacgugccaaugcgucugucgggcgggguugcgccccgcgucgugcggcccgcauaaggagcucgaucggaauagcugucaaugcgugugcaagaauaaguuguuuccgucgcagugcggggcgaaucgcgaguucgacgagaauacgugucaaugcgugugcaagcggacguguccgcgcaaccagccguugaaccccggcaagugcgcgugcgagugcaccgagucgccgcaaaagugucuccugaagggcaagaaauuucaucaucagaccuguucgugcuaucggcgccccugcaccaaucggcaaaaagccugcgaacccggguucagcuacuccgaggaggucugccgcugcgugcccagcuacuggaagcgcccgcagaugucguga

SEQ ID NO: 5606 - RNA, 1065 nt, Artificial Sequence
  derived and/or modified CDS sequence (opt10) from Homo sapiens__NP_004460.1__HsVEGFD
auguacagggaaugggucguagucaacgucuucaugauguuauacguacaauuaguacaagguucgucgaacgagcacgguccggucaagcguucgucgcaaucgacguuagagcguucggagcagcagauacgagcggcgucgucguuagaggaguugcuacggauaacgcacucggaggacuggaaguuauggcgaugucgauuacgcuuaaagucguucacaucgauggacucgaggucggcuucgcaccgcucgacgcgguucgccgcgacauucuacgacauagagacguuaaaggucaucgacgaggaguggcagcgcacgcagugcucgccgagggagacuugcgucgaggucgcgucagaauuggguaagucgacuaacacguuuuucaagccuccgugcguuaacgucuuccguugcggggguugcugcaacgaggagucguuaaucugcaugaacacaaguacgucauacaucucgaagcaauuauucgagaucucggucccauuaaccucggucccggaguuggugccgguaaagguagcgaaccacacggggugcaagugcuuaccgacggcuccgcgacacccguacaguauaauacgacggucgauacagauucccgaggaggaccgaugcagucacucgaagaagcuaugcccaaucgacaugcucugggacaguaacaagugcaagugcguauuacaggaggagaaccccuuggcggggacggaggaccacucgcacuugcaggagccggcguugugcggaccgcacaugauguucgacgaggaccggugcgagugcguaugcaagacuccgugcccgaaggacuugauucagcacccuaagaacugcucgugcuucgaaugcaaggagucguuagagacgugcugccagaagcacaaguuguuccacccggauacaugcaguugcgaggaccgaugcccguuccacacacgacccugcgcgucggguaagacggcuugcgcgaagcacugccgauucccuaaggagaagcgagcggcacaggguccgcacucucguaagaacccguga

SEQ ID NO: 5607 - RNA, 648 nt, Artificial Sequence
  derived and/or modified protein sequence (opt10) from Homo sapiens__NP_002119.1__HsHMGB1
auggguaaaggugacccgaaaaagccacgcgguaagaugaguucguaugcguucuucguccaaacgugccgagaggaacacaagaaaaagcacccggacgcgucgguaaacuucucggaguucucaaaaaagugcuccgaacgcuggaagacgaugucggcgaaagagaaagguaaauuugaagauauggcgaaagcggacaaggcgcgcuacgagagggagaugaagacauauauaccgccgaagggugagaccaagaaaaaguucaaggacccgaacgcgccgaagcggccgccgucugcguuuuuccuuuucuguucggaguaccgcccgaagauaaagggagagcacccgggccuuucgauaggcgacguagcgaaaaaguugggugaaauguggaauaacacggcggcggacgauaaacagccauaugaaaagaaagcagcgaagcucaaggaaaaguacgagaaagauaucgcggcauaucgagcaaaagguaaaccggacgcggcgaagaaagguguaguaaaagcagaaaagucgaagaaaaagaaagaggaagaggaagaugaagaggacgaggaagaugaagaggaagaggaagaugaagaggacgaggacgaggaagaggacgaugacgaugaauga

SEQ ID NO: 5608 - RNA, 847 nt, Artificial Sequence
  mRNA product Design1 comprising derived and/or modified sequence from Homo sapiens__NP_061986.1__HsFGF21 (opt10)
gggagaaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5609 - RNA, 1627 nt, Artificial Sequence
  mRNA product Design1 comprising derived and/or modified sequence from Homo sapiens__NP_002412.1__HsMMP1 (opt10)
gggagaaagcuuaccaugcauucguucccgccguuauuauuauuauuauuuuggggggucgucagccauucguuuccggccaccuuggagacccaggaacaggacgucgaucucgugcaaaaguauuuagagaaguauuauaauuuaaaaaacgacggccgccaggucgagaaaagacgcaacucggggccggucgucgagaagcucaaacagaugcaagaguuuuucggcuuaaaggucaccggcaagccggacgccgagacguuaaaagucaugaaacaaccgcgcugcggggucccggacgucgcccaauucguguugaccgaaggcaauccgaggugggaacagacccacuuaacguaucgcaucgagaacuauaccccggaccucccgcgcgccgacgucgaucacgcgaucgaaaaggcguuucaguuguggucgaacgugaccccguuaaccuuuacgaaagugagcgaagggcaggccgauauaaugaucagcuucgugcgcggggaccacagagauaauagcccguucgacgggccgggggggaacuuggcccacgccuuccagccggggccggggaucgggggcgacgcccacuucgacgaggacgagcgcuggacgaauaacuuucgcgaauauaaucuccacagggucgccgcccacgaguuggggcacagcuugggguugagucacagcaccgacauaggcgcccucauguauccgucguauacguuuucgggggacguccaauuggcccaagacgauaucgacgggauacaggcgaucuacgggaggagucagaacccggugcaaccgauagggccgcagacgccgaaggccugcgauucgaaauugacguucgacgccaucaccaccaucagaggggaggucauguuuuucaaggaucgcuuuuauaugaggaccaacccguuuuaucccgaggucgaauugaacuuuaucagcgucuuuuggccgcaguuaccgaacggcuuggaggccgccuaugaguucgcggaucgcgacgaggugagauucuuuaagggcaacaaauauugggccguccaagggcaaaacgucuugcauggguauccgaaagauauauauucgaguuucggguuuccgcgcaccgucaaacacauagacgccgccuugagcgaagagaauaccgggaagacguauuuuuucgucgccaauaaguauuggcgcuacgacgaguacaagaggagcauggacccgggguacccgaagaugaucgcccacgauuucccggggaucgggcauaaggucgacgccgucuuuaugaaggacggguucuuuuacuuuuuccacgggacccgccaguauaaguucgacccgaagaccaaacgcauccucaccuugcaaaaggccaacucgugguuuaauugucgcaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5610 - RNA, 3283 nt, Artificial Sequence; identical to SEQ ID NO: 2317
  mRNA product Design1 comprising derived and/or modified sequence from Clostridium histolyticum__BAA34542.1__ColH (opt10)

SEQ ID NO: 5611 - RNA, 2404 nt, Artificial Sequence
  mRNA product Design1 comprising derived and/or modified sequence from Homo sapiens__NP_000592.3__HsHGF (opt10)
gggagaaagcuuaccaugugggucacgaaguuguuaccggcguuauuauuacaacacguguuguuacacuuguuguuauugccgauagcgauaccguaugccgaagggcagcgcaagcgccgcaauaccauccacgaguuuaagaagagugccaaaaccacguugauaaagaucgacccggccuuaaaaaucaagacgaaaaaggucaacaccgccgaucagugcgccaaccgcugcacccgcaacaagggguugccguuuaccuguaaagccuucgucuucgacaaggcccgcaagcaauguuugugguuuccguuuaacucgaugagcucgggggucaagaaggaguucgggcacgaguucgauuuguaugagaauaaggauuauauccgcaauuguauaaucgggaaagggaggucguauaaagggaccgucagcauaaccaaaucggggauaaaaugccaaccguggucgaguaugaucccgcaugagcauucguuccucccgagcucguacagagggaaggauuugcaagagaauuauugcaggaacccgaggggcgaggagggcgggccguggugcuuuaccucgaacccggaagucagguaugaggugugcgauaucccgcaaugcagcgaggucgaguguaugacguguaacggcgaaucguacaggggguugauggaccacaccgagagcgggaaaaucugccaaaggugggaccaccaaaccccgcauagacauaaauuucucccggagcgcuauccggauaaaggguucgacgacaacuacuguaggaacccggacgggcaaccccgcccgugguguuauaccuuggauccgcauacgaggugggaauauugcgccaucaaaaccugugccgauaacaccaugaacgauaccgacgucccgcucgagaccaccgaguguauacaggggcagggggagggguaucgcgggaccgugaacacgaucuggaacgggaucccgugccaaaggugggacagccaauauccgcaugaacacgauaugaccccggagaacuuuaaauguaaagauuugagggagaacuauuguaggaacccggacggcagcgagagcccguggugcuucacgaccgacccgaauauaagggucggguauuguagucagaucccgaauugcgacaugagccacgggcaagacugcuauaggggcaacgggaaaaacuacauggggaaucucagucagacccgcagcggguugaccugcagcaugugggauaaaaauauggaggaucuccacaggcacauauuuugggagccggacgccucgaaauuaaacgaaaacuauuguaggaacccggacgacgacgcccacgggccgugguguuauaccgggaacccguugaucccgugggacuauuguccgaucaguaggugcgagggggacacgaccccgaccaucgugaaccucgaucacccggucaucagcugcgcgaagaccaagcagcucagggucgucaacggcaucccgaccaggaccaauaucggguggauggucucgcuccgcuaucgcaacaagcacauauguggggggagccucaucaaagaaucgugggucuugaccgccaggcaaugcuuuccgagcagggaucucaaggacuacgaggccugguuggggauccacgacgugcaugggcgcggggacgaaaaguguaagcaagucuugaacgucagucaauuagucuacgggccggaggggagcgacuuaguccucaugaaauuggcgcgcccggccguguuagacgacuucgucucgaccaucgaccucccgaauuacggguguaccaucccggagaaaacgucguguucggucuauggguggggguauaccgggcucauaaauuacgacggguugcucagggucgcccacuuguauaucauggggaacgaaaaguguucgcaacaccacaggggcaaagucaccuuaaacgaaagcgagaucugcgccggcgccgagaaaaucgggagcgggccgugcgaaggcgacuauggggggccguuggucugcgaacagcacaaaaugcgcauggucuugggggugaucgucccggggagggggugcgcgaucccgaacaggccggggaucuucgugagggucgccuacuacgccaaguggauccauaagaucauccucaccuauaaagucccgcaaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5612 - RNA, 793 nt, Artificial Sequence
  mRNA product Design1 comprising derived and/or modified sequence from Homo sapiens__NP_001133.1__HsAMELX (opt10)
gggagaaagcuuaccauggguacguggauacucuucgcgugcuuguuaggugcggcguucgcgaugccguuaccgccgcacccaggccacccgggauacaucaacuucucguacgaggucuuaacgccgcucaagugguaccagaguauccgaccuccuuaccccucguacggauacgagccgaugggggguugguuacaccaccagauaauaccaguauugagucagcaacacccgccaacgcacacuuuacagccgcaccaccacauccccguaguccccgcgcagcaaccggucaucccgcaacagccgaugaugccgguacccgggcagcacucgaugacaccuauccagcaccaccaaccgaacuugccgccgccggcgcagcaacccuaccagccacagccgguccagccucaaccccaccagccuaugcagccucagccgccgguacacccgaugcagccguuaccaccgcagcccccguuaccgcccauguucccgaugcaaccccucccgccgauguuaccggacuuaacguuagaggcguggccuucgacggacaagacgaagcgcgaggagguugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5613 - RNA, 352 nt, Artificial Sequence
  mRNA product Design1 comprising derived and/or modified sequence from Homo sapiens__NP_001133.1__HsAMELX-TRAP (opt10)
gggagaaagcuuaccaugccguugccgccgcauccgggucacccgggguauauaaacuucucguaugaggucuugacgccgcucaagugguaccaaucgauucgcccgccuuacccgaguuauggguacgagccgauggggggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5614 - RNA, 796 nt, Artificial Sequence
  mRNA product Design1 comprising derived and/or modified sequence from Homo sapiens__NP_001134.1__HsAMELY (opt10)
gggagaaagcuuaccauggguacauggauauuauucgcgugcuuggucggugcugcauucgcaaugccauuaccuccccacccaggccacccgggguacauuaauuucucguacgagguauuaacgccgcuuaaaugguaccagaguaugaucaggccgccguacucgucguacggauacgaacccaugggggguugguuacaucaccagauaauaccgguagucucgcagcagcacccguuaacgcacacguugcaaucgcaccaccacauaccgguaguaccggcgcagcaaccucgcguuaggcagcaggcguuaaugccgguaccggggcagcagucgaugacaccgacccagcaccaccagccgaacuuaccauuacccgcucaacagccauuccagccgcaacccguccagccgcaaccccaucagccgaugcaaccgcaaccgccgguacagccgaugcagccguuguuaccgcagccgccguugccacccauguucccguuacgcccuuuaccuccgaucuuaccggacuuacacuuagaggcauggccggcgacggacaagacgaagcaggaggagguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5615 - RNA, 355 nt, Artificial Sequence
  mRNA product Design1 comprising derived and/or modified sequence from Homo sapiens__NP_001134.1__HsAMELY-TRAP (opt10)
gggagaaagcuuaccaugccguugccgccgcacccgggccauccgggguacauaaauuuuucguacgaagucuugacgccgcucaaaugguaucaaucgaugauccgcccgccguauagcaguuacggguaugaaccgauggggggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5616 - RNA, 3178 nt, Artificial Sequence
  mRNA product Design1 comprising derived and/or modified sequence from Homo sapiens__NP_006120.1__HsBMP1 (opt10)
gggagaaagcuuaccaugcccggagucgcgcgauugccauugcucuuagguuuguuauuauuaccacgcccggggaggccccucgacuuagcggacuacacguacgacuuggcagaggaggacgacucugaaccuuuaaacuacaaggacccgugcaaggcugccgcguucuuaggggacauagcguuggacgaggaggacuuacgcgcuuuccaaguccagcaggcgguugacuuaaggcgccacacggcgcggaaaaguucgaucaaggcggcgguacccgggaacacaaguacgccgucgugccaaaguacaaacggacaaccacagcgcggggcgugcggacgguggcgagggaggucgaggaguaggcgagcagccaccucgcgucccgagcggguauggccggacgguguaauuccauucguaauagguggcaacuucacgggaagucagcgggcgguauuccgccaggcgaugcgacacugggagaaacacacaugcguuacguucuuggagcgaaccgacgaggacucguacauaguauuuacguaccguccaugcggcugcugcaguuacguagggcgaagggguggcgguccgcaagcgaucucgauagguaagaacugcgacaaguucgguaucguaguucacgaguuaggucacguuguagguuucuggcacgagcacacgcgaccugaccgcgacaggcacgucaguauaguccgcgagaacauacagccgggacaggaguacaacuucuuaaaaauggagccgcaagagguugagucguugggugagacguacgacuucgacucgauaaugcacuacgcgcgaaacacguucucgcgcgggauuuucuuagacacaauaguuccgaaauacgagguaaacggcgucaagccgccgauaggccagcggacucgcuugucgaagggugacauagcgcaggcgcggaaguuguauaagugcccggcgugcggugagacauuacaggacucgacgggaaacuuuaguucgcccgaguacccuaacggcuacucggcgcacaugcacugcgucuggcgaauaucgguaacuccgggggagaagauuauuuuaaauuucacuucauuggauuuauauaggucgcgauuauguugguacgacuacguagaaguaagggacggguuuuggcguaaggccccuuugcgugggcgauucugcggaucgaaguuaccggagccgauaguaaguacggacucgcguuuauggguagaguuccgaaguucgaguaacuggguagguaaggguuucuucgccguuuacgaggcaauaugcgguggggacguaaagaaggacuacggucauauacagucuccgaauuacccggacgacuacaggccuaguaagguauguauauggcgcauccaagucucggagggauuccauguuggguugacguuucagaguuucgagauagagaggcacgacucgugcgcguacgauuacuuagagguaagggacggacauucggagucgaguacuuuaauaggacgauacugcgguuacgagaagccggacgacauaaagucgacuucgucgcgauugugguuaaaguucguuucggacggaaguauaaacaaggcagguuucgcgguuaacuucuuuaaggagguagacgagugcucgcgaccgaaccgaggcgguugcgagcaacgaugcuuaaacacguugggaucuuacaaaugcucuugcgacccggguuacgaguuggcgccggauaagaggcgaugcgaggcggcaugcggggguuucuuaacaaaguugaacgguucgauaacaucgcccggguggccgaaggaguacccgccgaacaagaacugcauauggcaauuagucgcgccgacacaauaccggauuucguuacaguucgacuucuucgagacggaggguaacgacgucuguaaguacgacuucgucgagguccgaucggguuugacugcggacucaaaguuacacgguaaguucugcggcucggagaagccggagguaauuacaucgcaguacaacaacaugcgagucgaguucaagucggacaacacgguaaguaagaagggguucaaggcacacuucuucucggauaaggacgaguguucgaaagacaacggggguugccaacaggacugcguaaacaccuucgguucguacgagugucagugccgaucggguuucguauuacacgacaacaagcacgacugcaaggaggcaggaugcgaccauaaggucacgucgacuucggggacgauaacgucgccgaacuggccggacaaguacccgucgaagaaggagugcaccugggcgaucucgucaacuccgggucaucgaguuaaguugacguucauggagauggauauugagucgcagcccgagugcgcguacgaccacuuagagguauucgacgggcgugacgcgaaagcaccgguauuaggaagguucugcgguucgaagaaacccgaaccgguuuuggcgacgggaagucguauguucuuacgguucuacucggacaauaguguacaacguaagggguuccaagcaucgcaugcgacggagugcgguggucagguccgagcggacguuaaaacgaaagacuuauacucgcacgcgcaguucggggacaauaacuacccgggcgggguugacugcgaguggguuauagucgcagaggagggguacgguguagaguuaguauuccagacuuucgaggucgaggaggagacggacugcgguuacgacuacauggaguuauucgacgguuacgacucgacggcgccacgauuagguagguacugcgggucgggaccgccggaggagguauacucagccggugacaguguauuagucaaguuucacucugacgacacgauaacgaagaagggcuuccacuuacguuacacgaguacgaaguuccaggacacguuacacucucgaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5617 - RNA, 1408 nt, Artificial Sequence
  mRNA product Design1 comprising derived and/or modified sequence from Homo sapiens__NP_001191.1__HsBMP2 (opt10)
gggagaaagcuuaccauggucgcgggcacgagguguuuguuggcacucuuauugccgcaaguauuguuagggggggccgcgggguugguccccgaguuagggaggcgcaaguucgccgccgcaagcagcgggaggccgagcagucagccgagcgacgagguauuaucggaguucgagcucagauuauugucgauguucggguuaaaacaacgcccgacgccgucgcgcgacgcggucgucccgccguauauguuggacuuauauaggcgccacagcgggcagcccgggagcccggcgccggaccacagacucgagcgcgcggcgucgagggcgaacacggucaggucguuccaccaugaagaaagccucgaagaauugccggaaacaucgggcaaaacgacgagacgcuucuucuuuaaucucucgagcauaccgaccgaggaguuuauaacgagcgccgaguugcaagucuucagggaacagaugcaagaugcgcucgggaacaauucgucguuccaucacaggauaaauauauaugaaauaauuaaaccggccacggcgaacagcaaauucccggucacgcgcuugcucgacacgcgccucgucaaucagaaugcgucgcgcugggaaucguuugauguaacgccggcggucaugagauggaccgcccaggggcacgcgaaccauggguucgucgucgaagucgcgcaccucgaggagaaacaagggguaaguaagcgccauguccgcauuucgcgcagccuccaccaagaugaacacucguggagccagauucgcccgcucuuggucacguuugggcaugaugggaaaggccauccguugcacaaacgcgaaaaaaggcaagcgaaacacaaacaaagaaaaagguugaagaguucguguaagcgccacccgcucuacgucgacuucucggacgucgguuggaaugacuggauagucgccccgccuggcuaucacgcguuuuauugccacggggaaugcccguuuccguuagccgaucauuuaaacaguacgaaucaugcgauaguccagacacucguaaacagcgucaacagcaagauaccgaaagcgugcuguguacccacggaauugucggcgauaagcauguuauauuuggacgagaaugaaaaggucguccucaaaaauuaucaggacauggucgucgagggguguggcuguaggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5618 - RNA, 1444 nt, Artificial Sequence
  mRNA product Design1 comprising derived and/or modified sequence from Homo sapiens__NP_001193.2__HsBMP4 (opt10)
gggagaaagcuuaccaugauaccgggaaacaggauguuaaugguaguauuguugugccagguauuauuggguggugccucgcacgcgaguuugaucccggagaccgguaagaagaagguagcggagauccagggccacgcggggggccgacguagcggucagucgcacgaguuauugcgagacuucgaggccacgcucuuacagauguucggucuucgccgaaggccgcagccgucuaagucggccgucauacccgacuacaugcgagacuuauaccgauuacagucgggcgaggaggaggaggagcagauccacaguacgggguuagaguacccggagcguccggccucgcgagcgaacacgguccgcucguuccaccacgaggagcacuuggagaacauaccgggcaccucggagaacagugcguucagauucuuauucaacuuaucgaguaucccagagaacgaggugauaucuagugcggaguugcgcuuauuccgugagcagguugaccaagggccggacugggagcgcggcuuccaccgaaucaacaucuacgaggugaugaagccgccggcggagguaguacccggucacuuaaucacucgucucuuagacacgcgauuaguacaccacaacguaacgaggugggagacguucgacgucaguccggcgguauugagguggacgcgcgagaagcagcccaacuacggauuagcgaucgaggucacgcaccuacaccagacccguacgcaccagggccagcacguccgaauaucgcgaucgcuaccgcagggaucggguaacugggcgcaauuaagaccguuguuaguaacguucggccacgacgggcgaggccacgcuuuaacgcgucgacgacgugcgaagcgcucgccgaagcaccacucgcagcgagcgcgaaagaagaacaagaacugccgacgucacagucuuuacguugacuucucggacgucggauggaacgacuggauaguugcgccgccgggcuaccaggcguucuacugccacggggacugcccguucccguuagccgaccacuuaaacaguaccaaccacgccaucguccagacgcuuguaaacucgguaaacaguucaauacccaaggcgugcugcguacccacggaguuaagugcgaucucgauguuauacuuggacgaguacgacaagguuguuuuaaagaacuaccaggagaugguuguggagggcugcggaugccguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5619 - RNA, 1759 nt, Artificial Sequence
  mRNA product Design1 comprising derived and/or modified sequence from Homo sapiens__NP_001709.1__HsBMP6 (opt10)
gggagaaagcuuaccaugcccggcuuaggcagacgcgcccaaugguuauguuggugguggggcuuauuauguucguguuguggcccgccccccuuaagacccccgcucccggccgcggccgcggcggcggcgggcggccaauuauuaggcgaugggggcucgccggggaggaccgaacaacccccccccagcccccaaaguaguagcggguuuuuauauagaagauugaaaacccaagaaaaaagagaaaugcaaaaagaaauacucagcgucuuaggcuugccccauagaccgagaccguuacauggguugcagcaaccccaaccgcccgccuugagacaacaagaagaacaacaacaacaacaacaauuaccgaggggggaaccgccgccgggcagguuaaaaagugccccguuguuuauguuagacuuauauaaugcguuaagugcggauaaugaugaagauggcgccagcgaaggcgaacgccaacaaaguuggccgcaugaggccgcgucgagcagucaaaggagacaacccccgcccggggcggcccaucccuugaauaggaaaucguuguuagcgccggggagcgggucggggggggccaguccguuaacgucggcccaagauucggcguuuuugaaugaugccgauauggugaugucguucgucaauuuagucgaauaugauaaagaauuuaguccgaggcaaaggcaucauaaggaauuuaaauuuaaucucagucaaaucccggaaggggaagucgucaccgccgccgaguuuaggauauauaaagauugcgucaugggcucguucaagaaucagaccuucuugauaucgaucuaccaggugcuccaagaacaccaacaucgcgauagcgauuuauuccuccucgauacgagggucgucugggcgagcgaggaggggugguuagaguucgauauaaccgcgaccucgaacuuaugggucgucaccccgcaacacaauaugggcuugcaauuaucggucgucacccgcgacggggugcaugugcauccgagggcggccggguuagucgggcgcgaugggccguaugauaaacaaccguuuauggucgccuuuuuuaaggucucggaaguccaugucaggacgacgcgcagcgcgaguucgagaaggaggcagcaaucgaggaacaggagcacgcaaagucaagaugucgccagagugaguucggccagcgacuauaauucgucggagcucaagaccgcgugucgcaaacacgaauuauacgucucguuucaggauuuaggguggcaagauuggauaaucgccccgaaaggguacgccgcgaacuauugcgacggggaguguaguuuuccguugaaugcccauaugaacgccacgaaucaugccaucguccaaacgcucguccauuugaugaauccggaauacgugccgaagcccuguugcgccccgaccaaauugaacgcgauaagcgucuuguauuucgacgauaauaguaacgugaucuuaaagaaguaucgcaacauggucguccgcgccugcgggugucauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5620 - RNA, 1513 nt, Artificial Sequence
  mRNA product Design1 comprising derived and/or modified sequence from Homo sapiens__NP_001710.1__HsBMP7 (opt10)
gggagaaagcuuaccaugcacguaagaucguuacgagcggcggcuccgcacaguuucguagcguugugggccccguuauucuuauugcgaucggcguuagcggacuucaguuuagacaacgagguacacucgaguuucauacaccgaagauugcgcucgcaggagaggcgcgagaugcagcgagagauauuaaguauauuaggguugccgcaccgacccaggccccacuugcaggggaagcacaacucggcuccaauguucauguuagacuuauacaacgcgauggcgguagaggagggggggggucccgggggucagggcuucaguuaccccuacaaggcgguauucucuacgcaggguccgccguuagcgaguuuacaggacucgcacuucuugacggacgcggacaugguaaugaguuucguaaacuuaguagagcacgacaaggaguucuuccacccgcgauaccaccacagggaguuccgauucgacuuaucgaagauacccgagggggaggcgguaacggcggcggaguucaggauauacaaggacuacauccgagagagauucgacaacgagacguuccgaauaaguguauaccagguauugcaggagcacuuagguagggagucggacuuauucuuguuagacagucgcacguuaugggcgucggaggaggguugguuggucuucgacauaacggcgacgaguaaccacugggucguaaaccccaggcacaacuuagguuuacaguugucgguagagacauuagacggucagucgauaaacccgaaguuagccggguugaucggucgacacggcccgcagaacaagcagccguucaugguagccuucuucaaggcgacggagguacacuucaggaguauaaggucgacggguaguaagcagcgaucgcagaacaggaguaagacaccaaagaaccaggaggcguuaagaauggcgaacguagcugagaacucgaguucggaccagaggcaggcgugcaagaagcacgaguuauacguaaguuuccgcgacuugggguggcaggacuggauaauagcgccggagggguacgcagcguacuacugcgagggugagugcgcguuccccuuaaacucguacaugaacgcgacgaaccacgcgauaguacagacguuaguacacuucaucaacccggagacaguaccgaagccgugcugcgcgccgacgcaguugaacgcgauaaguguauuauacuucgacgacucgaguaacguaaucuuaaagaaguacaggaacaugguaguacgagcgugcgguugccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5621 - RNA, 517 nt, Artificial Sequence
  mRNA product Design1 comprising derived and/or modified sequence from Homo sapiens__NP_006264.2__HsCCL7 (opt10)
gggagaaagcuuaccaugaaggcgucggccgcguuacuaugcuuauuacuuaccgccgcggcguucucgccgcagggcuuagcgcaaccgguagguauaaacaccaguacgacaugcugcuacagguucauaaacaagaagaucccgaagcagcgauuagagaguuaccgucguacgacgagcucucacugcccgcgugaggcggucauauucaaaacgaaguuagacaaggagauaugcgcagaccccacccagaaguggguacaggacuucaugaagcacuuagacaagaagacgcagacgccuaaguugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5622 - RNA, 3841 nt, Artificial Sequence
  mRNA product Design1 comprising derived and/or modified sequence from Homo sapiens__NP_001954.2__HsEGF (opt10)
gggagaaagcuuaccauguuauugaccuugauaaucuuacucccggucgucagcaaguucucguucgucucguugagcgccccccaacauuggucgugcccggaggggaccuuggccgggaacggcaacaguaccugcgucgggccggccccguuucucaucuuuagucacgggaacucgauauuccgcaucgauaccgaggggacgaacuacgaacagcucgucgucgacgccggggugagcgucauaauggacuuccacuacaacgaaaagcgcauauacugggucgaccucgagcgccaguugcuccagcgcgucuucuuaaacggcagccgccaggaacgcgucugcaacaucgaaaagaacgucagcgggauggccaucaacuggaucaacgaggaggucaucuggagcaaccagcaagaggggauaaucaccgucaccgacaugaaggggaacaacagucauaucuugcucucggcccucaaguacccggccaacgucgccgucgacccggucgagcgcuucaucuucuggagcagcgaagucgccgggucguuguaccgcgccgacuuggacggggucggggucaaagccuuacucgaaaccagcgaaaagaucaccgccgucagccucgacgucuuggacaaaagauuauucuggauccaauauaaucgcgaggggucgaacagcuugaucuguaguugcgacuacgacggggggagcgugcauaucucgaagcacccgacccaacacaaccucuucgccaugaguuuguucggggauaggauauuuuacagcaccuggaagaugaaaaccaucuggaucgcgaauaagcauaccgggaaagauaugguccgcaucaauuugcacagcagcuucgucccguugggggaguuaaaggucguccacccguuggcccagccgaaagccgaggacgauaccugggaaccggaacaaaaguuguguaagcuccgcaaggggaauuguucgucgaccgucugcggccaggauuugcaaagccaucucuguaugugcgccgaaggguaugcguugucgagggauagaaaauauugcgaggacgucaacgagugcgccuucuggaaccacgggugcaccuugggcugcaagaauacgccggggaguuacuauuguaccuguccggucggguucgucuuauugccggacggcaagaggugccaccaguuggucaguugcccgaggaacgucagcgaguguucgcacgauugcgucuuaaccagcgaggggccgcucugcuuuugcccggaggggagcgucuuggaacgcgacggcaagaccugcucggggugcaguagcccggacaacggggggugcucgcaauugugugucccguugucgccggucaguugggagugcgacuguuucccgggcuacgauuugcaguuagacgagaagucgugcgccgccagcgggccgcagccguuccucuuauucgcgaacagccaggacaucaggcauaugcacuucgacgggaccgauuacgggaccuuauugucgcaacaaauggggauggucuacgcguuggaccacgauccggucgagaacaaaaucuauuucgcgcacaccgcguuaaaauggaucgaacgcgccaacauggacgggagucaaagggagcgcuugaucgaagagggggucgacgucccggagggguuggccgucgauuggaucgggaggcgcuuuuacuggaccgaucgcggcaagagcuuaaucgggcgcucggaccucaacggcaagaggaguaagaucauaaccaaagaaaauauaagccagccgagggggaucgccguccacccgauggcgaaacgccucuuuuggaccgacaccggcaucaacccgaggaucgagucgagcaguuugcagggguuggggagguuagucaucgcgucgagcgacuugauauggccgucggggaucaccaucgauuuucucaccgauaaacucuauuggugugacgcgaaacaaagcgucaucgagauggcgaacuuagacgggagcaagaggaggcgcuugacgcaaaacgacgucgggcauccguucgccgucgccgucuucgaagacuacgucugguuuagcgacugggccaugccgagcgucaugcgcgucaauaaacgcaccgggaaggaccgcgucagguugcaggggucgauguuaaaaccgagcagcuuagucgucguccacccgcucgccaagccgggggccgacccgugucucuaccagaauggggggugcgagcacaucuguaagaaacgcuuggggaccgccuggugcagcugcagggagggguucaugaaggcgagcgacggcaagaccugcuuagccuuagacgggcaccaauuacucgccgggggggaggucgacuugaaaaaucaggucaccccgcucgauauacucaguaaaacccgcgucagcgaggacaauaucaccgagagccagcauauguuggucgccgagauaauggucagcgaccaggacgauugcgccccggucggguguucgauguacgccagaugcaucagcgaaggggaagacgcgaccugccaaugccucaagggguucgccggcgacgggaaguugugcagcgacaucgacgagugcgaaaugggggugccggucuguccgccggcgaguaguaaauguauaaauacggaggggggguacguguguagauguagcgagggguaucagggggacggcauccauugcuuggacaucgacgaaugucaguuaggcgaacauucgugcggggaaaacgcgucguguaccaacaccgaagggggguacacguguaugugcgccgggagguuaagcgagccgggguuaaucuguccggauagcaccccgccgccgcauuugcgcgaggacgaucaucauuacaguguccgcaacucggauagcgagugcccguuaagucaugacggcuauuguuugcacgacggggucuguauguacaucgaggcccucgauaaauacgccuguaauugcgucgucggguauauaggcgaaaggugccaauauagggauuuaaaauggugggaguuaaggcaugccgggcauggccaacaacaaaaagugauagucgucgccgugugugucgucgucuuggugauguuauuguuguuaucguuauggggcgcgcauuauuaucgcacccaaaaauuauugagcaagaauccgaaaaacccguacgaagaaagcucgcgcgacguccgcucgaggcgcccggccgauaccgaagacggcaugaguagcuguccgcagccgugguucgucgucaucaaggagcaucaggauuugaaaaacggcgggcagccggucgccggggaagacgggcaagccgccgacggcagcaugcagccgaccagcuggcgccaagaaccgcaacucugcgggauggggaccgaacagggguguuggaucccggucaguucggacaaagggaguugcccgcaagucauggaaaggucguuccacaugccgaguuacggcacccaaacguuggagggcgggguggaaaaaccgcacagcuuguugagcgccaauccgcucuggcagcagcgcgcguuagauccgccgcaucagauggaauuaacccaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5623 - RNA, 727 nt, Artificial Sequence
  mRNA product Design1 comprising derived and/or modified sequence from Homo sapiens__NP_001423.1__HsEREG (opt10)
gggagaaagcuuaccaugacggccggccgccgcauggaaauguugugcgcggggcgcgugccggccuuauuauuguguuuaggguuucacuuguugcaagccguguugucgaccaccgucaucccgagcugcauaccgggggaaaguucggacaauuguaccgcccucguccaaaccgaggauaacccgagggucgcccaggucagcaucaccaaaugcucgagcgauaugaacggguacugccuccacgggcaauguauauacuuagucgauaugucgcagaauuauugucgcugcgaggucggguacaccggggugaggugcgagcauuuuuuccucacggugcaucagccgcucucgaaggaguacgucgcccucacggucaucuugaucauccucuucuugauaaccgugguggggaguaccuacuacuuuugucgcugguaucgcaacaggaagucgaaggagccgaaaaaagaguacgaacgcgucacgagcggcgacccggaacucccccaggugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5624 - RNA, 685 nt, Artificial Sequence
  mRNA product Design1 comprising derived and/or modified sequence from Homo sapiens__NP_000791.1__HsFGF1 (opt10)
gggagaaagcuuaccauggcggagggugagauaacgacguucacugcguuaacggagaaguucaacuuaccgccggguaacuacaagaagcccaaguuguuauacugcucgaacggggggcacuucuuacgaauauuaccagacggcacgguagacgguacccgagaccggucggaccagcacauccaguuacaauuaucggcggagaguguuggcgagguauacaucaagucgacugagacagggcaguacuuggcgauggacacggacggguuauuguacgggagucaaacgccgaacgaggagugcuuauucuuagagcgcuuggaggagaaccacuacaacacguacaucucgaagaagcacgcggagaagaacugguucguaggguuaaagaagaacgguaguugcaagcgggggccacgcacgcacuacggucagaaggcgaucuuauucuugccguuaccaguaucgagugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5625 - RNA, 1084 nt, Artificial Sequence
  mRNA product Design1 comprising derived and/or modified sequence from Homo sapiens__NP_001997.5__HsFGF2 (opt10)
gggagaaagcuuaccauggugggcgucgggggcggggacguggaggacgugaccccgcgcccgggcgggugccagaucucgggccggggcgcccgcgggugcaacggcauccccggggccgcggccugggaggccgcccugccccggcgccggccccgccggcacccguccgucaacccccgcucgcgggccgcgggcucgccccgcacccgggggcgccggacggaggagcgccccuccggcucccggcucggcgaccgcgggcggggccgcgcccugcccgggggccggcugggcgggcgcggccgggggcgcgcccccgagcgcgugggcgggcggggccgcggccgggggaccgccgcgccccgcgccgcccccgccgcccggggcucgcgcccggggcccgcgggcaccauggccgccggguccaucaccacgcuccccgcccugcccgaggacggcggcucgggggccuucccgcccggccacuucaaggaccccaagcggcuguacugcaagaacgggggcuucuuccuccgcauccaccccgacgggcggguggacggcguccgcgagaaguccgacccgcacaucaagcugcagcugcaggcggaggagcggggcguggugucgaucaagggggucugcgccaaccgcuaccucgccaugaaggaggacggccggcugcuggccuccaagugcgugaccgacgagugcuucuucuucgagcgccucgagucgaacaacuacaacaccuaccggucccgcaaguacaccucgugguacguggccuuaaagcggacggggcaguacaaguuaggcuccaagaccggccccgggcagaaggcgauccucuucuuacccaugucggccaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5626 - RNA, 802 nt, Artificial Sequence
  mRNA product Design1 comprising derived and/or modified sequence from Homo sapiens__NP_002000.1__HsFGF7 (opt10)
gggagaaagcuuaccaugcacaaguggauauuaacguggauauugccgacguuauuauacaggucgugcuuccacauaauaugcuuggucgggacaauaaguuuagcgugcaacgacaugacgcccgagcaaauggcgacgaacguaaauugcucgaguccggagagacacacgaggucguaugacuauauggaggggggcgacauaagagucaggagauuauucugcaggacacaaugguauuugagaauagacaagaggggcaaagucaaggggacgcaagagaugaaaaacaacuauaacauaauggagauaagaacgguagccgucggcauagucgcgauaaaagggguagagagugaguucuauuuagcgaugaacaaggaggggaaguuauaugcgaagaaggagugcaacgaggacugcaauuucaaggaguugauauuagagaaccacuauaacacguacgcgucggccaaguggacacacaacggcggggagauguucgucgcguuaaaccaaaagggcauaccggucagggggaagaagacgaagaaagagcaaaagacggcgcacuucuugccgauggcgauaacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5627 - RNA, 844 nt, Artificial Sequence
  mRNA product Design1 comprising derived and/or modified sequence from Homo sapiens__NP_001936.1__HsHBEGF (opt10)
gggagaaagcuuaccaugaaguuguuacccucaguuguacucaaauuauucuuagcggccguauuaagugcucuugugaccggcgagucguuggagcguuugcgccgcggucuugcagcgggcacgaguaacccggacccgccgacggucucgaccgaccaguuacucccucucgggggcgggcgcgaccguaagguucgggaccuccaggaggcggacuuagaccuccuacguguuacgcuuucgucgaagccccaggccuuggcgaccccuaacaaggaggagcacgguaagcguaagaagaaggggaaggggcuuggcaagaagcgugacccgugcuugcgaaaguacaaggacuucugcauacacggggagugcaaguacgucaaggaguuacgagcgccgaguugcaucugccacccgggcuaccacggggagcgaugccacggcuugucguuaccgguagagaaccguuuguacacuuacgaccacacuaccauacucgccguagucgcgguugucuuaucgucgguaugcuuauuaguaauaguaggcuuauuaauguuccgauaccaccgacgcgggggcuacgacguagagaacgaggagaaggugaagcuagggaugacgaacucgcacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5628 - RNA, 2404 nt, Artificial Sequence; identical to SEQ ID NO: 5611
  mRNA product Design1 comprising derived and/or modified sequence from Homo sapiens__NP_000592.3__HsHGF (opt10)

SEQ ID NO: 5629 - RNA, 2143 nt, Artificial Sequence
  mRNA product Design1 comprising derived and/or modified sequence from Homo sapiens__NP_005336.3 __HsHSPA1A (opt10)
gggagaaagcuuaccauggcgaaggcggcggcaauagggauagacuuagguacgacguacucgugcguugguguauuccagcacgguaagguagagauaauagcgaacgaccaggguaaccggacgacgccgaguuacgucgcguucaccgacacggagcgcuugaucggggacgccgcgaagaaccagguagcuuuaaacccacaaaacacgguuuucgacgcaaagcgacucauagggcgaaaguucggggaccccgucguacaaucagacaugaagcacuggccguuccaggucauaaacgacggugacaagccgaagguccagguaaguuacaagggcgagacgaaggcguucuacccugaggagaucucaaguaugguauugacgaagaugaaggagauagcggaggcauacuuaggauaccccgugacgaacgccguaaucacgguccccgcguacuucaacgacucucagcggcaggcgacgaaggacgcaggcguaaucgcaggguuaaacguauugcgcaucauaaacgagccgaccgcggcggcgauagcauacggguuagaccggaccgggaagggugagcgaaacguauuaaucuucgacuuggguggggguacguucgacgucucgauauuaaccaucgacgacggcauauucgagguaaaggcgaccgccggggacacgcacuuaggcggggaggacuucgacaaccgauuggucaaccacuucguagaggaguucaagcgaaagcacaagaaggacauaucgcagaacaagcgugcgguaagaagguuacgaacggcgugcgagcgggcuaagcgcacguuaaguucgaguacgcaggcgucguuggagauagacaguuuauucgaggguauagacuucuacacuucgauaacgcgugcacgauucgaggaguuaugcucggacuuauucaggucgacguuagagccgguagagaaggcauuacgagacgcgaaguuggacaaggcacagauacacgacuuaguauuaguaggugguucgacgcggauaccgaagguacagaaguuguuacaggacuucuucaacggucgagacuuaaacaagucgaucaacccggacgaggcgguagcguacggggccgcgguacaggccgcgauauugaugggugacaagagugagaacguacaggacuuauuauuauuagacguagcacccuuaucuuuggguuuagagaccgcggguggggucaugacggcguuaauaaagcgaaacucgacgaucccgacgaagcagacccagaucuucacuacguacucggacaaccagccggguguauugauccagguauacgagggugagcgagcgaugaccaaggacaacaacuuauuaggacguuucgaguugucggguauaccgcccgcaccucgaggggucccgcagaucgaggucacguucgacaucgacgcgaacgguaucuuaaacguaacggcgaccgacaaaaguacggggaaggccaacaagaucacgauaacgaacgacaagggucgauuaucgaaggaggagauagagaggaugguccaggaggcagagaaguacaaggccgaggacgagguccagagagagcgaguaagugcgaagaacgcguuggagucguacgcguucaacaugaagagugcggucgaggacgaggguuuaaaggguaagaucucggaggccgacaagaagaaggucuuagacaagugccaggagguuauaucuugguuagacgcgaacacguuagcggagaaggacgaguucgagcacaagcgcaaggaguuagagcagguaugcaacccgauaauaucggguuuguaccagggggcgggcgggccggguccgggugguuucggcgcgcagggaccgaagggugguagugggucggguccgacgaucgaggagguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5630 - RNA, 2143 nt, Artificial Sequence; identical to SEQ ID NO: 5629
  mRNA product Design1 comprising derived and/or modified sequence from Homo sapiens__NP_005337.2 __HsHSPA1B (opt10)

SEQ ID NO: 5631 - RNA, 2143 nt, Artificial Sequence
  mRNA product Design1 comprising derived and/or modified sequence from Homo sapiens__NP_005518.3 __HsHSPA1L (opt10)
gggagaaagcuuaccauggcgacggcgaaggguauagcuauagguauagacuuaggaacgacauacucgugcguaggugucuuccagcacgggaaggucgagaucauagcuaacgaccaggggaacaggacaacgccgaguuacgucgcguucaccgacacugagagauugaucggugacgcggcgaagaaccaggucgcgaugaacccucaaaacacgguauucgacgcgaagcgguuaaucggucgcaaguucaacgacccggucguucaggcggacaugaaguuauggccguuccaaguaauaaacgagggcggaaagccgaagguauugguaucguacaagggugagaacaaggcauucuacccggaagagauaaguucgaugguuuuaaccaaguuaaaggagacagcggaggcguucuuaggucauccgguaacuaacgcgguaaucacgguacccgcuuacuucaacgacagucagcggcaggcgacgaaggacgcgggggucauagcggguuuaaacguauuacgcauaauaaacgagccaacggcagcggcgauagcguacggucuugacaaggggggacagggugagcggcacguauuaaucuucgacuuagguggcgguacauucgacgucucgauauugacgaucgacgacgguauauucgagguaaaggcgacggcgggugacacgcacuuagguggugaggacuucgacaacagauuaguaagucacuucgucgaggaguucaagcggaagcacaagaaggacauaucgcaaaacaagcgcgcuguaaggagauugcggacggccugcgagcgcgcgaagcggacguuaaguucgucgacgcaggcgaaccucgagauagacucguuguacgaggguauagacuuuuacacgaguaucacgcgagcgagauucgaggaguuaugcgccgacuuauuccgcgggacauuggagcccguugagaaggcguuaagggacgcgaagauggacaaggcgaagauccacgacauaguauuagucggugguucgacccgaauaccgaagguacagcgguuauuacaagacuacuucaacggucgcgacuugaacaagucgauaaacccggacgaggcgguagcguacggggcggcaguccaggcggcgauauuaaugggggacaagucggagaagguccaagacuuauuauuguuggacguugcgccguuaaguuuagguuuagagacugcgggcgguguaaugacggcguuaaucaagcggaacucgacaauaccaacgaagcagacgcaaauauucacuacguacagugacaaccagccggguguauugauacagguauacgagggugagcgggcgaugacgaaggacaacaacuuauuaggucguuucgacuuaacugguauaccuccggcuccgcgggggguaccgcaaauagaggucacguucgacauagacgcgaacgggaucuuaaacguaacggcgaccgacaagucgacagguaagguuaacaagauaacuauaacgaacgacaaggguagauuaucgaaggaggagaucgagaggauggucuuggacgcggagaaguacaaggcagaggacgagguacagagagaaaagauagcggcgaagaacgcguuagagaguuacgcguucaacaugaagucgguaguaucggacgagggauuaaaggguaagaucucggagagugacaagaacaagauauuagacaagugcaacgaguuauuaucgugguuggagguuaaccaguuagcggagaaggacgaguucgaccauaagaggaaggaguuagagcaaaugugcaacccgaucaucacgaaguuauaccagggggguugcacggguccggcgugcgguacggguuacgucccugggcgaccggcaacagguccgacgauagaggagguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5632 - RNA, 2137 nt, Artificial Sequence
  mRNA product Design1 comprising derived and/or modified sequence from Homo sapiens__NP_068814.2 __HsHSPA2 (opt10)
gggagaaagcuuaccaugucggccagggggccggccauagggaucgauuuggggacgacguauagcugugucggggucuuucaacaugggaagguggagaucauagccaaugaucagggcaaucgcacgaccccgaguuacgucgcguucaccgauacggagagguugauaggggaugccgcgaaaaaucaagucgccaugaauccgaccaauaccauauuugaugccaaacgcuugauagggaggaaauuugaggaugccaccgugcagucggauaugaaacauuggccguuuagggucgucagugagggggggaagccgaaaguacagguggaguauaagggggaaaccaaaacguucuuuccggaggaaauaagcucgauggucuugacgaagaugaaggagaucgccgaagccuacuugggggggaaagugcauucggccgucaucaccgugccggccuauuucaaugauucgcagcgccaggccaccaaggaugccgggacgaucaccggguugaauguguugaggaucauaaacgagccgaccgccgccgccauagccuauggguuggauaaaaaggggugugcggggggggaaaagaauguguugaucuuugauuuggggggcgggaccuuugaugugagcaucuugacgaucgaggaugggauauuugaagugaagucgaccgcgggggauacccauuuggggggcgaggauuuugauaauaggauggucucgcacuuggcggaggaauuuaagcgcaaacauaaaaaggacaucgggccgaauaagagagccguccgccgcuugcgcacggccugugagagagccaagcgcacguugucgagcucgacccaggccucgaucgagauagauaguuuguaugagggcgucgauuuuuauacgagcauaaccagagcgagguucgaagaguugaaugcggacuuauuuagggggaccuuggagccgguggagaaggccuugagggaugccaagcucgauaaggggcagauccaggagaucguguuagugggggggaguacgaggauaccgaagauacagaaguuguugcaggauuuuuuuaauggcaaggaguugaauaagagcaucaauccggacgaggccguggcguauggggccgccguccaggccgccaucuugauaggcgauaagucggaaaaugugcaggauuuguuguuauuggaugucacgccguugagcuugggcaucgaaaccgccgggggggucaugacgccguuaaucaagaggaauaccacgaucccgaccaagcaaacgcaaacguuuaccacguauucggauaaucaaagcagugucuuggugcaagucuaugaaggggagagggccaugaccaaggauaauaauuugcucgggaaauuugauuugaccgggauccccccggccccgaggggggucccgcagauagaggugaccuucgauaucgaugcgaaugggauauugaaugucacggccgcggauaagucgaccggcaaagagaauaaaauaaccaucaccaaugauaagggccgcuuaucgaaggaugauaucgauaggauggugcaggaggccgagagguauaagagcgaggacgaagccaaucgcgauaggguggccgccaaaaaugccuuagagagcuauacguauaauauaaaacaaacgguggaggaugagaaguuaagggggaagaucucggagcaggauaagaauaagaucuuagauaagugccaggaggugaucaauugguuggauaggaaucagauggcggagaaggaugaguaugagcauaagcagaaggaguuggagagggucuguaauccgaucauaagcaagcucuaucagggggggccgggggggggcucgggggggggggggaguggggccucgggggggccgacgauagaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5633 - RNA, 2740 nt, Artificial Sequence
  mRNA product Design1 comprising derived and/or modified sequence from Homo sapiens__NP_002145.3 __HsHSPA4 (opt10)
gggagaaagcuuaccaugucagucguagguaucgaccucgguuuucaaaguuguuacguagcgguagcgcgagcuggagguauagagacgauagcaaacgaauacucggaccgaugcacuccugcgugcauaucguucgggccgaagaacaggucgauaggggccgcggcaaagucgcagguuaucucaaacgcgaaaaacacgguacaggguuucaagcgauuucacggucgugcguucucggacccuuucgucgaggccgagaagaguaacuuagcguacgacauaguucaauuaccgacgggucucacgggcauuaagguaacuuacauggaagaggagcgcaacuucacuacggagcagguaacggcgauguuguuaucgaaguuaaaggaaacggcagagucgguauuaaagaagccagugguagacugcguaguaucaguaccgugcuucuacacggacgcggagcggcguucgguuauggacgccacgcagauagcggggcucaacuguuuacgccuaaugaacgagacgacggccguagcguuagcguacgggauuuacaagcaggacuugccagcgcuugaggagaagccgcgcaacguuguauucguggacaugggacacucggcauaccaggugucggucugcgcguucaaccgggggaagcucaaggucuuagcgacggcguucgacaccacguuaggcggacgcaaguucgacgagguacucguuaaccacuucugcgaggaguucgguaagaaguauaaguuagacauaaagucgaagauucgagcguugcuucguuuaucgcaggagugcgagaaguuaaagaaguuaaugucagcgaacgcgucggacuugccccuuucgaucgagugcuucaugaacgacguagacguuucagggaccaugaacagggggaaguucuuagagauguguaacgacuuauuggcacgagucgaaccucccuugaggucggucuuagagcagacaaaguugaagaaggaggacauauacgcgguagagaucgucggaggggcaacgcguauuccggcaguuaaggagaagauaucgaaguucuucggcaaggaguuaucgacgacgcuuaacgcggacgaggcgguaacgagggguugcgcguuacagugcgcuauacuuucuccagcguucaagguacgcgaguucucgauaacggacguuguuccguaccccaucaguuuacgguggaacucgccggcggaggaggguucgucggacugcgagguguucucgaagaaccacgcggcgcccuucucgaaggucuuaacguucuaccgaaaagagccguucacauuagaggcauacuacaguucgccacaggaccuuccuuacccggacccggcgaucgcacaguucucgguacaaaagguuacgccccagucggacgguucgucgucgaaggucaagguaaaggugaggguuaacguucacgguaucuuuucggucaguucggcgucgcuuguagagguccacaagucggaggagaacgaggagccgauggagacggaccagaacgcgaaagaggaggagaaaaugcagguagaccaggaggagccgcacguagaggagcagcaacagcagacgccggcggagaacaaggcggagucggaggagauggagacuucgcaggcgggcucgaaggacaagaaaauggaccagccuccgcaggcgaaaaaggcgaaggucaagacaucuaccgucgacuuaccgauagagaaccaguuauuguggcaaaucgaccgagagauguuaaacuuauacaucgagaacgaggggaaaaugaucaugcaggacaaguuggaaaaggagcgcaacgacgcgaaaaacgcgguugaggaguacguuuacgagaugcgugacaaguuaucgggcgaguacgagaaguucgucucggaggacgaccgaaacucauucacguuaaaguuggaggacacggagaacugguuauacgaggacggggaggaccaaccgaagcagguauacgucgacaagcuagcggagcuuaagaacuugggacagcccauaaagaucagguuccaagagagugaggagcgcccgaagcuauucgaggaguuagguaagcaaauacagcaguacaugaagaucauaucuaguuuuaagaacaaggaggaccaauacgaccacuuagacgcggcagacaugacuaaggucgagaagaguacgaacgaggcgauggaguggaugaacaauaaguuaaacuuacaaaacaagcagucguuaacgauggacccgguaguaaagucgaaggagaucgaggccaagaucaaggaguuaaccucuacaugcucgccaaucauaucgaagccgaagccgaagguagagccgccgaaggaggagcagaagaacgccgagcaaaacggccccguagacggucagggugacaaccccgggccucaggcggcagaacaggggacggacaccgcgguaccgucugacucggacaaaaaguuaccggagauggacaucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5634 - RNA, 2737 nt, Artificial Sequence
  mRNA product Design1 comprising derived and/or modified sequence from Homo sapiens__NP_055093.2 __HsHSPA4L (opt10)
gggagaaagcuuaccaugagcgucgucgggaucgauuugggguucuugaauuguuauauagccguggcccgcucgggggggauagaaacgauagcgaacgaauauucggaucgcuguacgcccgcgugcaucagccucgggagccgcaccagggcgauagggaacgccgccaaaucgcaaaucgugaccaauguccgcaacaccauccacggguuuaagaaauugcacggcaggagcuucgacgauccgaucguccagaccgagcgcauacgcuugccguacgaauuacaaaagaugccgaacgggucggccggggucaaagucagauaucucgaagaggaacgcccguucgccaucgaacaagucaccgggauguuacucgcgaaauugaaggaaaccagcgagaacgcccucaaaaagccggucgccgauugcgucaucagcaucccgucguuuuucaccgacgcggaacgccgcagcgucauggccgccgcgcaagucgccgggcucaacugccuccgccucaugaacgagaccaccgccgucgccuuagccuacgggaucuacaagcaagacuugccgccgcucgacgaaaagccgcgcaacgucgucuucaucgacauggggcauagcgcguaccaagugcucgucugcgccuuuaauaaagggaaguugaaggugcucgccaccacguucgacccguaccucggggggcgcaauuucgacgaagcccucgucgauuauuuuugcgacgaauuuaaaacgaaguacaaaaucaacgucaaggagaauagcagagcgcuccucaggcucuaccaagaaugcgagaaguugaaaaaauugaugucggccaacgccagcgacuugccgcucaauaucgaaugcuuuaugaacgauuuggacgucagcucgaagaugaaucgcgcccaguucgaacaauuaugcgccaguuugcucgcgcgcgucgagccgccgcucaaagccgucauggagcaagccaaucuccaaagggaggauaucucgucgaucgagaucgucgggggggccaccaggaucccggccgucaaggagcaaauaaccaaguuuuucuugaaggauaucucgacgacccucaacgccgacgaggccgucgcccgcgggugcgcccuccaaugcgccaucuugagcccggccuucaaggucagggaguucaguaucaccgauuuggucccguacagcauaacccuccgcuggaaaacgagcuucgaggacgggucgggcgagugcgaggucuuuugcaaaaaucauccggcgccguuuagcaaagugaucaccuuucauaaaaaagagccguucgaguuggaggccuucuacaccaaccuccaugaggucccguauccggacgcccgcaucggcucguuuaccauccaaaacgucuucccgcaaagcgacggggacucgaguaaggucaaagucaaggucagggucaauauacacgggauauuuucggucgccucggccagcgucaucgaaaaacagaaccucgagggggaccauucggacgccccgauggaaaccgagaccagcuucaagaacgagaauaaggacaacauggacaagaugcaagucgaccaagaggagggccaccagaagugccacgccgagcauaccccggaggaagagaucgaccauaccggggcgaagaccaaaagcgccgugagcgauaagcaagauaggcucaaccaaaccuugaagaaggggaaaguaaagucgaucgacuugcccauacaaucgucguugugccgccaauuggggcaagacuuguuaaauucguauaucgagaacgaaggcaaaaugauaaugcaagacaaacucgaaaaggagcgcaacgacgccaaaaacgcggucgaggaguacgucuacgacuuccgcgaucgcuuagggaccguguacgagaaguuuauaaccccggaagaucucucgaaauuaagcgccguccucgaggauaccgaaaacugguuguacgaggauggggaagaucaaccgaagcaggucuacgucgacaaauugcaggaguugaaaaaguaugggcaaccgauccaaaugaaauauauggaacacgaagaacgcccgaaggcgcucaacgaucucgggaaaaaaauacaauuggugaugaaagucaucgaagccuaccgcaauaaagacgagcgcuacgaccacuuagacccgaccgaaauggagaaagucgagaagugcauaucggacgcgaugucgugguuaaacucgaaaaugaacgcccaaaauaaguugucguugacccaggacccggucgucaaggucagcgagaucgucgccaaaagcaaagaguuagacaacuuuugcaauccgauaaucuauaaaccgaaaccgaaggccgaggucccggaggauaagccgaaggccaacucggaacauaacgggccgauggacgggcaaucggggaccgagaccaagagcgacagcaccaaggauucgagccaacacaccaaaaguagcggggaaauggaggucgauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5635 - RNA, 2182 nt, Artificial Sequence
  mRNA product Design1 comprising derived and/or modified sequence from Homo sapiens__NP_005338.1__HsHSPA5 (opt10)
gggagaaagcuuaccaugaaauugaguuuagucgcggccauguuauuauuauugucggccgccagagcggaagaagaagauaaaaaagaagaugucgggaccgucguggggauagauuuaggcacgacguauaguugugugggggucuuuaaaaaugggagggucgaaauaauagcgaaugaccaagggaauaggauaacccccaguuacguggcguuuaccccggagggcgagagguuaaucggggacgcggcgaaaaaucaauugacgaguaauccggaaaauaccguguucgaugcgaaaagauugauagggaggaccuggaacgaucccagcguccaacaagauauaaaauuucuccccuuuaaagucgucgagaaaaagaccaagccguauauccaggucgacaucggggggggccagaccaaaaccuucgccccggaggagaucagcgcgauggucuugaccaagaugaaggagacggccgaagccuaccucgggaaaaaagucacgcacgccgucgucaccgucccggcguacuucaacgacgcgcagaggcaggccacgaaggaugccgggaccaucgccggguugaacgucaugcgcauaauaaaugaaccgaccgccgccgccaucgccuacggguuagacaaacgcgaaggcgaaaaaaauauauuagucuucgauuuagggggggggacguuugacgucagcuuguugacgaucgauaacgggguguuugaggucgucgcgaccaacggggacacccacuuagggggggaggauuucgaucaaagggugauggagcauuuuauaaaguuauauaagaaaaaaaccgggaaggacgugcgcaaggauaaccgcgccguccaaaaguugagaagggaagucgagaaagcgaagagagcguuaagcagccaacaccaggcccgcaucgagaucgaaaguuuuuacgagggggaggauuucagcgaaacguuaaccagagcgaaguucgaggaauugaauauggacuuauuuagaagcaccaugaaaccggugcaaaagguccucgaggacagcgaccucaaaaaaagcgacaucgacgagaucgucuuggucggggggagcaccaggaucccgaaaauccaacaguuagucaaggaauuuuuuaacgggaaagagccgaguagggggaucaauccggacgaggccgucgccuacggggccgccgugcaagccggggucuugagcggggaccaggacaccggggauuuagucuuauuggacgucugcccguugaccuuggggaucgagaccgucgggggggugaugacgaaguuaaucccgcgcaauaccgucgucccgacgaaaaaaagccaaauauucagcaccgccagcgacaaccagccgaccgucaccauaaaaguguacgagggggagcgcccguuaaccaaggauaaccacuuguuagggaccuucgacuuaaccgggaucccgccggccccgaggggcgugccgcaaaucgaggugacguucgaaaucgacgucaacgggaucuugagggucaccgccgaggauaaagggaccggcaauaagaacaaaauaaccauaacgaacgaucaaaacagguuaaccccggaggagauagagcgcauggucaacgacgccgaaaaauucgccgaagaggauaagaaauugaaagaaaggaucgacacccgcaacgaacucgagucguacgcguacagcuugaaaaaccaaaucggggacaaggagaaauuaggggggaaguugaguagcgaggacaaagaaacgauggagaaggccgucgaggagaaaaucgagugguuagagucgcaucaggacgccgauaucgaggauuuuaaggccaaaaaaaaagaguuagaggagaucguccagccgaucauaucgaaguuguacgggucggccgggccgccgccgaccggggaggaagacaccgccgagaaggacgaacucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5636 - RNA, 2149 nt, Artificial Sequence
  mRNA product Design1 comprising derived and/or modified sequence from Homo sapiens__NP_002146.2__HsHSPA6 (opt10)
gggagaaagcuuaccaugcaagcgccgagagaauuggccgucgggauagauuuagggacgacguauagcugugucggggucuuccaacaagggagggucgaaauauuagcgaaugaucaagggaauaggacgaccccgucguaugucgcguuuacggauacggaaagauuagugggcgaugccgcgaaaucgcaagccgcguuaaauccgcauaauacggucuuugacgcgaaaagauuaauaggcaggaaauuugccgauacgaccguccaaagcgauaugaaacauuggccguuuagagucgucucggaaggggggaaaccgaaagucagggucuguuauaggggcgaagauaaaaccuuuuauccggaagaaauaagcaguauggucuuaucgaaaaugaaagaaaccgcggaagccuauuuagggcaaccggucaaacaugccgucauaacggucccggcguacuuuaacgauagccaaaggcaagcgacgaaagaugccggcgcgauagccggcuugaauguccucagaauaauaaacgaaccgaccgccgccgcgauagcguacggcuuagauagaagaggggccggggaaaggaaugucuugaucuucgauuuagggggcgggacguuugacgucagcgucuugaguaucgaugccgggguguucgaagucaaggcgaccgccggggacacgcauuuagggggggaagauuuugauaauagauuggucaaucauuuuauggaggaguuuagaagaaaacacggcaaagauuuaucgggcaauaaaagggcguuaaggcgcuuaaggaccgcgugcgaaagggcgaaaaggacguuaaguaguucgacgcaagcgacguuagaaaucgauaguuuauuugaaggggucgauuuuuauaccaguauaaccagggcgagguucgaagaguuauguagcgauuuguuuaggucgacguuagaacccgucgaaaaagcguuaagagacgcgaaauuagauaaagcgcaaauccacgaugugguguuagucggcgggaguaccaggauaccgaaaguccaaaaacucuuacaagauuuuuuuaaugggaaagaauuaaauaaaucgauaaauccggacgaagccgucgcguacggcgccgccguccaagccgcgguccucaugggcgauaagugcgaaaagguccaagacuuguuauuauuagacgucgccccgcucagcuuaggcuuagaaaccgccgggggcgucaugacgaccuuaauacaacgcaaugcgaccauaccgacgaaacaaacgcaaaccuuuacgacguauagcgauaaucaaccgggcguguuuauacaagucuacgaaggggaacgcgcgaugacgaaagauaauaauuuauuaggcagguucgaguugucggggauaccgccggcgccgaggggggugccgcaaaucgaagucaccuucgauaucgacgccaacgggauauuaucggucaccgcgaccgaucgcucgaccgggaaagccaauaaaauaacgauaacgaacgauaaagggagauuaucgaaagaagaagucgaacgcaugguccacgaggcggaacaauauaaagccgaagacgaagcgcaacgcgaucgcgucgccgcgaagaauagcuuagaagcgcacguguuucacgucaaggggagccuccaggaagagucguugcgcgauaaaaucccggaggaagaucgcaggaagaugcaggauaaaugcagagagguguuggcgugguuagaacauaaucaauuagccgaaaaagaagaauacgaacaccaaaaacgcgaauuagaacagauaugcaggccgauauuuagucgcuuguacggcggcccgggggugccgggcgggucgucgugcgggacccaggcgaggcaaggcgauccgucgacggggccgauaaucgaagaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5637 - RNA, 1321 nt, Artificial Sequence
  mRNA product Design1 comprising derived and/or modified sequence from Homo sapiens__P48741__HsHSPA7 (opt10)
gggagaaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagucgcaggccgcgcucaacccccacaacacgguguucgacgccaagcgcuuaaucggccggaaguucgccgacaccaccguccagagcgacaugaagcacuggcccuuccagguggugucggagggcgggaagcccaaggucagggugugcuaccggggcgaggacaagaccuucuacccggaggagaucagcagcaugguguuauccaagaugaaggagacggccgaggcguaccucgggcagcccgucaagcacgccgugaucaccgugcccaccuacuucucgaacagccagaggcaggccaccaaggacgccggcgccaucgcggggcugaaggucuuacccaucaucaacgaggccacggccgccgccaucgcguacggccucgacagacgcggcgccgggaagcggaacgugcugaucuucgacuuaggcgggggcaccuucgacgugagcgucuugaguaucgacgccggcguguucgaggugaaggccaccgccggggacacccacuuaggcggggaggacuucgacaaccgccuggucaaccacuucauggaggaguucagacgcaagcacggcaaggaccucucggggaacaagcgggcguuaaggcgguuaaggacggccugcgagcgggccaagaggaccccgaguagcuccacccaggccacccucgagaucgacagcuuauucgagggcguggacuucuacaagaguaucacgcgggccagguucgaggaguuaugcagcgacuuguucagguccaccuuagagcccguggagaaggcguuaagagacgccaagcucgacaaggcccagauccacgacuucgucuuaggcgggggccugcacagccacccccagggggccgagguggcggccggccuccugcagcgccagggggccgagcaggagcaccagcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5638 - RNA, 2158 nt, Artificial Sequence
  mRNA product Design1 comprising derived and/or modified sequence from Homo sapiens__NP_006588.1 __HsHSPA8 (opt10)
gggagaaagcuuaccaugucgaaggggccggcgguagguauagacuuaggcacgacguacucgugcguagggguauuccagcacggcaagguagagaucaucgcgaacgaccaggggaaccgaacaacgccgucguacguagcauucaccgacacggagcgcuuaauaggcgacgcggcgaagaaccagguagcgaugaacccgacuaacacggucuucgacgcgaagcgguuaaucggucgacgguucgacgacgcgguaguacagucggacaugaagcacuggcccuucauggucguuaacgacgcagguagaccgaagguacagguggaguacaagggcgagaccaagucguucuacccggaggaggucucgucgaugguguuaaccaagaugaaggagaucgcggaggcguacuuggguaagacggugacgaacgcagucguuacggucccggcguacuucaacgacagucagcgacaggcgacuaaggacgcggguacgaucgcgggauuaaacgucuuacgaaucaucaacgagccgacggcggccgcgauagcguacgggcuagacaagaagguaggugcggagaggaacguauuaaucuucgacuuggggggcgggacguucgacguaucgauauuaaccaucgaggacgguauuuucgagguaaagaguaccgcaggggacacccacuuagggggggaggacuucgacaaccguaugguaaaccacuucauagcggaguucaagcggaagcacaagaaggacauaucggagaacaagcgcgccguacgacguuuacggacggcgugcgagagagcgaagcgaaccuuaaguucgaguacucaggcaucgauagagauagacucguuauacgaggggaucgacuucuacacgucgaucacgcgagcgcgguucgaggaguugaacgccgacuuguuccgagggacgcuugacccgguggagaaggcguuacgggacgcuaaguuagacaagagucagauacacgacauaguauuaguaggggggucgacgcgaaucccuaagauacagaaguuauugcaggacuucuucaacggcaaggaguuaaacaagaguauaaacccggacgaggcaguagccuacggggcggcgguacaggcggcgauucucucgggugacaagucggagaacgugcaggacuuauuauuauuagacguaacgcccuuaucgcucgggaucgagacggcgggggggguaaugacgguauugaucaagaggaacacgacgauaccgacgaagcaaacgcagacguucacgaccuacucggacaaccagccgggcguauuaauacagguauacgagggcgagcgggccaugacgaaggacaacaaccuuuuagguaaguucgaguuaacggguauuccgccggcgccgagggggguaccgcaaaucgagguaacguucgacauagacgcgaacgggauccuuaacguaagugcgguagacaagucgacggguaaggagaacaagaucacgauaacgaacgacaagggccgcuuaaguaaggaggacaucgagcgcaugguacaggaggcggagaaguacaaggcggaggacgagaagcagcgagacaagguaucgucgaagaacucguuggagaguuacgcguucaacaugaaggcgacgguagaggacgagaaguuacaggguaagaucaacgacgaggacaagcagaagaucuuggacaagugcaacgagauaaucaacugguuagacaagaaccagacggcggagaaggaggaguucgagcaccagcaaaaggaguuagagaagguaugcaacccgaucauaacgaagcuauaccaguccgcgggugggaugccgggggggaugccgggcgguuuccccggagggggugccccgccgagugggggggcgucgucgggcccgacgaucgaggaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5639 - RNA, 2257 nt, Artificial Sequence
  mRNA product Design1 comprising derived and/or modified sequence from Homo sapiens__NP_004125.3 __HsHSPA9 (opt10)
gggagaaagcuuaccaugaucucggcgucgagggccgccgccgcgagguuggucggggcggccgcgaguagagggccgaccgcggcgaggcaucaagacucguggaacggguugucgcacgaagccuuccgcuuggucagccgcagagacuacgccagcgaggcgauaaaaggggccgucgucgggaucgaucucgggaccacgaauaguugugucgccgucauggaggggaagcaagcgaaagucuuagaaaacgcggagggggcgcgcacgacgccgagcgucgucgcguucaccgccgacggggaaagguuggucgggaugcccgcgaaaaggcaagccgugacgaauccgaauaauaccuucuacgccacgaaaagguugaucgggagaagguacgacgacccggagguccaaaaggauaucaagaacgucccguuuaagaucgugagggcgaguaacggggacgcgugggucgaagcccauggcaagcucuacagccccucgcaaauaggggccuucguccucaugaaaaugaaggaaaccgccgagaacuaucucggccauaccgccaagaacgccgucauaaccgugccggccuacuuuaacgauagccaacgccaagcgaccaaagacgccgggcaaauuagcggguuaaacgucuugagagucaucaacgaaccgaccgccgccgccuuggcguacggguuggauaagagcgaggauaagguaaucgccgucuacgaccucgggggggggaccuucgacaucagcauauuagagauccaaaagggggucuucgaagucaagaguaccaacggcgacacguuucucgggggcgaggauuucgaucaagcgcucuugagacauaucgucaaagaauuuaaacgcgaaaccggcgucgaccucaccaaagauaauauggccuugcaacgcgucagagaggccgccgagaaagccaagugcgaguugaguagcagcguccaaaccgauauaaaccucccguacuugaccauggacagcagcgggccgaaacaccucaacaugaaacucacgagggcccaguucgagggcaucgugaccgacuugauacgccgcaccauagccccgugucaaaaggccaugcaggacgccgagguaucgaaaucggauaucggggaggucauauuggucggggggaugacccgcaugccgaaaguccaacaaaccguccaagauuuguucgggcgcgcgccgucgaaagccgugaacccggacgaagccgucgcgaucggggccgcgauccaaggggggguccucgcgggggacgugaccgacgucuuauuguuggacgugaccccgcucagcuuagggaucgagaccuugggggggguguucacgaaguugaucaaccgcaacacgaccaucccgacgaaaaaaucgcaagucuuuagcaccgcggccgacgggcagacccaggucgagaucaaggucugucaaggggagcgcgaaauggccggggauaauaaguuguuggggcaauucacccucaucgggaucccgccggcgccgaggggggucccgcaaaucgaggucaccuucgauaucgacgcgaacggcaucguccacgucagcgccaaggacaaggggaccgggagggaacaacaaaucgucauacaaagcagcggggggcucucgaaggacgacaucgagaacauggucaaaaacgccgaaaaauacgccgaggaggauagaaggaaaaaagagagggucgaggcggucaauauggccgaggggauaauccaugauaccgaaacgaaaauggaagaguuuaaagaucagcucccggccgacgaauguaauaaauuaaaggaggaaaucaguaagaugcgcgaauuguuagcccgcaaagauucggaaaccggggagaacauccgccaagccgcgaguagcuugcaacaagccagcuuaaaauuauuugagauggccuauaaaaaaauggccagcgaaagggaggggagcgggucgagcgggaccggcgagcaaaaagaggaccagaaagaagagaaacaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5640 - RNA, 2245 nt, Artificial Sequence
  mRNA product Design1 comprising derived and/or modified sequence from Homo sapiens__NP_079291.2__HsHSPA12A (opt10)
gggagaaagcuuaccauggcagacaaggaagcaggggguucggacggcccucgugagacugcaccuacuucggcguacucuucgccggcucgaucguuaggugacacugggaucacgccguuaaguccgucgcacauaguaaacgauacggacaguaacguaucggagcagcagucguucuuaguaguaguagcgguggacuucgguaccacgucgucggguuacgcguacucguucacgaaagagccggagugcauacacgucaugcggaggugggaggggggagacccgggcguaaguaaccagaagacaccuacgacgauauuauuaacgccggagcggaaguuccacucguucgguuacgcggcccgugacuucuaccacgacuuagacccaaacgaggcaaagcaaugguuauacuuggagaaauucaaaaugaaguuacacacuacgggagacuuaacgauggacacugacuugacugccgcgaacgguaaaaagguaaaggcgcucgagaucuucgcguacgcauuacaguacuucaaggagcaggccuuaaaggagcucucugaccaggcugggucagaguucgagaacagugacguaagguggguaauaacuguaccggcgauauggaagcagccagcgaagcaguucaugcgccaggcagcguaccaggcgggguuagcgucgccggagaacagugagcaguuaauaaucgcuuuagaaccggaagcggcgucgauauacugccggaaguuacguuuacaccaaaugauagaguuaucaaguaaggcggcgguuaacggguacucagguucggacacuguuggggcggguuucacgcaggcgaaggagcacauccgacgaaacaggcaaucgcgcacauuccucgucgagaacguuauuggcgagauuuggagugagcuugaggagggagacaaguacguaguaguagacucgggugggggaacuguugauuuaacgguacaccaaauuaggcucccagagggucacuuaaaggagcucuacaaggccacgggugguccguacgguagucucgggguugacuacgaguucgagaaguugcucuacaagaucuucggugaggacuucauagagcaguuuaagaucaagcguccggcggcguggguagaccucaugauagcuuucgaaucgcgaaagcgcgccgcagcgccggaccgaacgaacccuuugaacaucacguuaccguucucguucauagacuacuacaagaaguuccguggacacucgguagagcacgcguuacgaaagaguaacguagacuucguaaaguggucgagucaggguaugcuucgcaugucgcccgacgcgaugaacgcguuauucaagccuacuaucgacucgauaauagaacacuugagggacuuauuccagaagccggagguaucgacgguaaaguucuuauucuuagucgggggguucgcagaggcgccguuguuacagcaggcaguucaggcggcguucggugaccagugccgaauaauaauaccccaggacguaggguuaacgaucuugaagggggcgguuuuauucggguuagacccggccguaauaaagguucgacguucacccuugacuuacggugucggcgucuuaaaccgauacguagaggggaagcacccaccggaaaaguuguuagucaaggacggaacacgauggugcacggacguauucgacaaguucauaucggccgaccaaaguguagcguuaggcgaguuaguaaagcgaucguauacgccugccaagccgucgcaauuaguaauagucaucaacaucuacaguucggagcacgacaacguaaguuuuauaacggacccgggagucaagaagugcggaacauuaagguuagacuugacggguacgucggguaccgcgguuccagcgcgccgagagauacagacgcucaugcaguucggugacacggagauaaaggcgacggcgauagacaucgcuacgucuaagucgguaaaggucgguaucgacuuucucaacuacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5641 - RNA, 2278 nt, Artificial Sequence
  mRNA product Design1 comprising derived and/or modified sequence from Homo sapiens__NP_443202.3 __HsHSPA12B (opt10)
gggagaaagcuuaccauguuagcaguacccgagaugggauuacaagguuuauacauagguucgucgcccgagcguucgccgguuccgucgccuccggggucgccacgcacgcaagagucgugcgggauagcaccuuuaacuccuucccagaguccuaagccggaaguucgugcaccgcagcaggcaucguucagugucguagucgcuauagacuucgguacaacaucgucggguuacgccuucucguucgcuucggacccggaggcaauccauaugaugcguaagugggaggguggugacccuggugucgcgcaccaaaagacgccuacgugcuuauuauuaacgccugagggggcguuccacucguucggauacacggcgcgagacuacuaccacgacuuggaccccgaggaggcucgcgacugguuauacuucgaaaaguucaaaaugaagauacacucggcgacugacuuaacguuaaagacacaacucgaggcgguuaacgggaagacaaugccggcguuagaggucuucgcgcacgcguugagguucuuccgcgagcacgcgcuccaggaguuacgagagcaaucgccgucauugccggagaaagacacgguccguugggucuuaaccgucccggcgaucuggaagcaaccggcgaaacaguucaugcgagaggcggcuuauuuagcgggguuaguaucgcgugagaacgcggagcaauuauuaauagcguuagagccggaggcggcgucaguuuacugucgaaaguugcgauugcaccaguuguuagauuuaucaggaagggcgccgggaggcgggcgauugggcgagaggcgaucgauagacucgucguuccgacaggcgcgcgagcagcuccgucguucgaggcauucgcggacguucuuaguagagucggguguuggugaguuaugggcggaaaugcaggcgggugaccguuacguagucgcugacugcgguggggggacgguagacuuaacaguucaccaguuagagcagccacacgguacguugaaagagcuuuacaaggcgucaggagggccguacggggccguagggguugauuuagcguucgagcaguugcucugccggaucuucggcgaggacuucaucgcaacauucaagcgccagcguccagcggcaugggucgacuuaacaauagcguucgaggcacguaagcggacggcaggaccgcaucgagcgggugcauuaaacauaaguuuaccguucucguucauagacuucuaccggaagcaacgcggucacaacguagagacggcgcucaggcgaaguucggucaacuucguaaaguggaguucgcaggguauguugcgcaugaguugcgaggcgaugaacgaguuauuccagccaacaguuucaggcauuauacagcacauugaggcauuauuggcgcgccccgagguacagggggucaagcucuuauucuuggucggaggauucgcggagucggcaguauuacagcacgcaguacaagcggcuuuaggugcgaggggcuuacgcguaguaguaccccacgacgucgguuugacuauauugaagggcgccguuuuauucggucaggcuccgggagucgucaggguucgacggucuccauuaacuuacggugucgguguauuaaaccguuucguccccgguaggcacccgccggagaaguuauugguacgagacggucgaagguggugcacggacguguucgagcguuucguagcagcggaacagucagucgcguuaggagaggagguaaggcguucguacuguccugcaaggccaggacagcgucgagucuuaauuaacuuguauuguugcgcagcggaggacgcacgauucauaacugacccggguguacggaagugcggugccuuaaguuuggaguuagaaccggcggacugcggucaggacacggcgggugcaccaccgggucgucgagagauccgagcagcgaugcaauucggugauacugagauaaaggugacggcgguagacguuucgacuaacaggucgguccgagcaucgaucgacuucuuaucgaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5642 - RNA, 1633 nt, Artificial Sequence
  mRNA product Design1 comprising derived and/or modified sequence from Homo sapiens__NP_008879.3__HsHSPA13 (opt10)
gggagaaagcuuaccauggcgcgcgaaaugacuauacucgggucugcggucuuaacguuacucuuagcagguuacuuagcgcagcaguaccuuccucuuccgacacccaagguaauaggaauagacuuagguacgacauacugcagugucggaguauucuucccgggaacugguaaggucaagguaauaccggacgagaacggacacaucucuaucccgucgauggucucguucacggauaacgacguuuacgucggguacgagucggucgaguuagcggacucuaacccgcagaacacgaucuacgacgcuaagcgauucaucgguaagauauucacggcggaggaguuagaggcagagauagguagguacccguucaaggucuugaacaagaacgggaugguagaguucucaguaaccucgaacgagacgaucacuguaagucccgaguacgucgguucacguuuacuauuaaaguugaaggagauggcggaggcguacuugggcaugccgguagcgaacgcaguaauaucgguccccgccgaguucgacuuaaagcaacgaaacucgacgaucgaggcggcgaacuuagcggggcuuaagauccuucgagugaucaacgagccgacggcggcggcgauggccuacggguuacacaaggccgacguauuccacgugcuugucaucgacuuaggaggugggacacucgacgucucgcuuuugaacaagcaggguggaauguucuugacgcgugcgaugucggguaacaacaaguugggugggcaggacuucaaccagcgauuauuacaguacuuguacaagcaaauuuaccagacguacgguuucgucccgucacgaaaggaagagauacaucgauuaaggcaggcagucgagaugguaaaguugaacuugacguuacaccagucggcgcaauuaagugucuuguuaacgguugaggagcaggaccguaaggagccgcacucgucggacaccgaguuaccgaaggacaaguugucgucggcugacgaccacaggguaaacucggguuucggcagggguuuaucagacaagaagucgggcgagucgcagguacucuucgagacggagaucagucgaaaguuauucgacacguuaaacgaggacuuauuccaaaagaucuuaguuccgauccagcagguuuuaaaggagggucacuuagagaagacggagauagacgagguugucuuggucggugguucgacgcgaaucccccgaaucaggcagguaauacaggaguucuucgggaaggacccaaacacgucggucgauccggacuuagcgguuguuaccgguguugcgauucaggccgggauagacggggguucguggccguuacagguaucagcgcucgagauaccgaacaagcacuugcagaagacgaacuucaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5643 - RNA, 1747 nt, Artificial Sequence
  mRNA product Design1 comprising derived and/or modified sequence from Homo sapiens__NP_057383.2__HsHSPA14 (opt10)
gggagaaagcuuaccauggccgcgauagggguccauuuaggguguacgagcgcgugcgucgcgguguacaaagacgggagagccggggucgucgccaacgacgcgggggauagggucaccccggccgucgucgccuauagcgagaacgaggaaaucgucgggcucgccgccaagcagucgcgcauccgcaacaucagcaauaccgucaugaaggucaaacaaauauuagggcgcucgaguucggauccgcaggcgcaaaaguauauagccgagucgaagugccucgugaucgaaaagaacggcaagcucagguacgagaucgacaccggggaggagaccaaguucgucaauccggaggacgucgcgcgcuuaauuuuuucgaaaaugaaggagaccgcccacagcguccucgggagcgacgccaacgacgucgucaucaccgugcccuucgacuucggggaaaaacagaagaacgccuugggggaggccgcccgcgccgccggguucaacguccucaggcucauccaugaacccagcgccgccuuguuggccuacgggaucgggcaggauaguccgaccgggaagucgaacauccucgucuuuaaauugggggggaccagucucagcuugucggugauggaggucaauucggggaucuacagagucuugagcacgaauaccgacgacaauauagggggggcccauuuuaccgagacgcucgcccaauacuuggccagcgaauuucagcgcaguuuuaagcacgacguccgcgggaacgccagggcgaugaugaagcucaccaauucggccgaggucgccaaacacagccucagcacgcucgggucggcgaauugcuuuuuggauagccucuacgaggggcaggacuucgacuguaacgucagucgcgcccgcuucgaguuguugugcagcccguuguucaacaaaugcaucgaggccauacgcggguugcucgaccagaacggguuuaccgccgacgacauaaauaaagucguguugugcgggggcagcagcaggauaccgaaauugcaacaauuaaucaaggacuuguuuccggccgucgaauuguugaacagcauaccgccggacgaggucauaccgaucggggccgccaucgaggccgggaucuugaucggcaaggagaauuuacucgucgaagauagcuugaugaucgaaugcagcgcgcgcgacauccucgucaaaggggucgaugagagcggggcgucgcgcuuuaccgucuuauucccgagcggcaccccgcucccggccaggcgccagcauacccuccaagcgccggggucgaucagcagcgucuguuuggaguuguacgaaagcgacggcaaaaauagcgcgaaagaagagacgaaauucgcccaagucgucuugcaagaucucgauaagaaggagaacgggcucagggacauccucgccgucuugaccaugaagcgcgacgggagccuccacgucaccuguaccgaccaagaaaccgggaagugcgaggccauaagcaucgaaaucgccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5644 - RNA, 2794 nt, Artificial Sequence
  mRNA product Design1 comprising derived and/or modified sequence from Homo sapiens__NP_006635.2 __HsHSPH1 (opt10)
gggagaaagcuuaccauguccgugguaggacucgacgucgggagccaaagcugcuacauagcgguagccagggcaggcgggauagagacgaucgccaacgaguucuccgaucgcugcacacccagcgucaucagcuuugguucuaaaaacaggacuauaggaguggccgcgaaaaaccaacaaauaacccaugcaaacaacaccgucagcaacuucaaacgauuccacggacgugccuucaacgacccguuuauacaaaaagaaaaagaaaaccuauccuacgaccuagucccccucaagaauggaggcgugggcaucaaaguuauguauaugggagaagaacacuuguucucaguagaacagauaaccgccaugcuacuaacaaaacugaaggaaaccgcagagaacagucugaagaaaccugucaccgacugcguaaucuccguacccuccuucuucaccgacgcagaacggagauccguacuagacgcagcccaaauaguaggccuaaacugccuccgcuugaugaacgauaugacggccguagcacucaacuaugggauuuacaaacaagaccucccaagccucgacgaaaaaccccgcauaguagucuucgucgacaugggacacucagcauuccagguaagcgcaugcgccuucaacaaaggaaaacucaaagucuuaggcacggcuuucgaccccuuccuaggcgggaaaaauuucgacgagaaacucgucgaacacuucugcgccgaguucaaaaccaaauacaaacucgacgcaaagagcaaaauccgagcccuccuacgcuuauaccaggaaugcgaaaagcuaaagaaauugauguccuccaacuccaccgaccuacccuuaaacaucgaauguuucaugaacgacaaggacgucagcggaaagaugaacagaucccaguucgaggagcucugcgccgaguuauuacaaaagauagaagucccccucuacagccuucucgaacagacccaccucaaaguagaagacguuucagccgucgaaaucgucggcggagcaacacgcauccccgcggucaaagaacgcaucgccaaauucuucgggaaggacauauccaccacccuaaacgcagacgaagcaguggcacgcgggugugcccuccagugcgccaucuuaagccccgcauucaaaguacgagaguucucaguaaccgaugccgucccguucccaauaagccugauauggaaccacgacagcgaggacaccgaagguguccacgaagucuucagucgaaaccacgcggccccauucucaaaaguauuaacguuccuccgacgcggacccuucgaacucgaagcauucuacagcgacccgcaaggcguaccguacccugaggcaaagauuggcagguucguaguccagaacgucuccgcacaaaaagauggcgagaaaagccgcguaaaggucaaaguccgagucaauacacacggaaucuucaccauuuccaccgccucaaugguagaaaaaguccccacagaagaaaacgagaugagcucugaagccgacauggagugccucaaccaacgcccacccgaaaaccccgacaccgacaagaacguccaacaagacaacagcgaagcaggaacccagccccaaguccaaaccgacgcacaacagaccagccagagcccacccucccccgagcucacaucagaagaaaauaagaucccagacgcagacaaggccaacgaaaagaaagucgaccagcccccggaggccaagaaacccaaaaucaaaguggucaacguagaacuccccaucgaagcaaaccuggucuggcagcuagguaaagacuuauuaaacauguacaucgaaaccgaaggcaaaaugauaaugcaagauaaacucgaaaaagaacgcaacgacgccaaaaacgcagucgaagaauacguauacgaguuccgggacaaauuaugcggcccauacgaaaaauucaucugugaacaagaccaccaaaacuuucuacguuuauuaaccgaaaccgaagacuggcucuacgaagaaggcgaagaucaagcaaaacaggcuuacgucgauaaacucgaagaacuaaugaaaaucggaacgccggucaaagugcgguuccaagaagcagaagaacgucccaaaauguucgaggaacucggacaaagacuccaacacuacgcgaaaaucgccgccgacuuccgcaacaaagacgagaaguacaaccacaucgacgaaucagaaaugaagaaaguagaaaagucggucaacgaaguaauggaauggaugaacaacguaaugaacgcccaagccaaaaagucccucgaccaagacccagucguccgagcacaagaaaucaaaaccaaaauuaaggaacucaacaauaccugcgagcccgucguaacgcaaccgaaaccaaaaauagaaucccccaaacucgaacgaacccccaacgggccgaacaucgacaagaaagaagaagaccucgaggacaaaaacaacuucggagcagaaccaccacaccaaaacggcgaaugcuacccaaacgagaaaaacagcgucaacauggaccucgauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5645 - RNA, 3217 nt, Artificial Sequence
  mRNA product Design1 comprising derived and/or modified sequence from Homo sapiens__NP_006380.1 __HsHYOU1 (opt10)
gggagaaagcuuaccauggccgauaagguccgccgccaacgcccccgccgcagggugugcugggcgcucgucgccgucuugcucgccgauuuacucgccuuaucggacaccuuagccgucaugagcgucgauuuagggucggaaaguaugaaagucgcgaucgugaagccgggggucccgauggagaucgugcucaacaaagagagcagacgcaagacccccgucauagucacguuaaaggagaacgagcgcuuuuucggggauucggccgccucgauggccaucaaaaacccgaaagccaccuugagguauuuucaacauuuguuaggcaaacaagccgacaauccgcacgucgccuuguaucaagcgagguuucccgaacaugaauuaaccuuugauccgcaacgccaaaccguccauuuccaaauaucgagccaauuacaauuuagcccggaagagguccucgggauggucuugaacuacagcaggagcuuggccgaggacuucgccgaacaaccgauaaaagacgccgucauaacggucccgguguuuuuuaaucaagcggaaaggagggccgucuuacaagccgccaggauggccggguugaaggucuuacaauugauaaacgauaauacggcgaccgcguugucguacgggguguuuaggagaaaggacaucaauacgaccgcgcaaaacauaauguuuuacgauauggggagcgggucgacggucuguacgaucgucacguaucaaauggucaaaaccaaagaggccggcaugcaaccgcaauuacaaauaagaggggucggguucgauaggacguuaggcggguuagaaauggaauugagauugagggagagguuagccggcuuguuuaacgaacaaaggaaagggcaacgcgccaaagacgucagagaaaaucccagggcgauggcgaaauuauuaagggaagccaacagauugaagacgguguugucggcgaaugccgaucauauggcccaaaucgagggguuaauggacgacgucgauuuuaaagccaaggucaccagggucgaguucgaagaacucugcgccgaucucuucgaaagagucccgggcccgguccaacaagcguugcaaucggcggagaugucguuagacgaaaucgaacaagucauauuagucgggggcgcgaccagagugccgcgcguccaagaagucuuauuaaaagcggucgggaaagaagaauuaggcaaaaauauaaacgccgacgaggccgcggcgaugggcgccgucuaucaagccgccgccuugucgaaggcguucaaggucaaaccguucguggugagggacgccgucguguauccgauauuagucgaauuuacccgcgaagucgaagaagaaccgggcauccauucguuaaaacauaacaagagagucuuguuuagcagaaugggcccguauccgcagaggaaggugauaacguucaauagguauucgcacgacuuuaauuuucauauaaauuauggggauuuaggguuuuuaggcccggaggacuugagagucuucgggagucaaaacuuaacgaccgucaaauugaagggcgucggggauucguuuaaaaaauacccggauuaugaaaguaaagggauaaaagcccauuuuaauuuagacgaaucgggggucuugucguuggaucgcgucgaaagcgucuucgaaaccuuagucgaagauucggccgaggaagagagcaccuugacgaaguuggggaauacgaucaguucguuauucgggggggggacgaccccggacgcgaaagaaaacgggaccgacaccgugcaagaagaggaagaaucgccggccgaaggcucgaaagaugaaccgggcgaacaagucgaauugaaagaagaggccgaagcgccggucgaagacgggagccaaccgccgccgccggagccgaaaggggacgccacgccggaaggggagaaagcgaccgagaaggagaacggcgauaaaagcgaagcgcaaaagccgucggaaaaagccgaagccggcccggaagggguggccccggcgccggaaggggaaaaaaaacaaaaaccggcgcgcaaaagaaggauggucgaagaaauaggcgucgaauuagucgucuuagauuuaccggaucucccggaagacaaauuagcccaaagcguccaaaaguugcaagaucucaccuugagggauuuagaaaaacaagagagagagaaggccgcaaauucgcucgaggccuuuaucuucgaaacgcaagauaaauuauaucaaccggaauaucaagaggucaguaccgaagaacaaagggaagaaauaagcggcaaauugucggcggccaguacgugguuagaagacgaaggggucggggcgacgaccgucaugcucaaagaaaaauuagccgaauuacgcaaauuaugucagggcuuauucuucagagucgaagaaaggaaaaaauggccggagagauuaagcgcguuggacaacuuguugaaucacaguucgauguuuuugaaaggcgcgagauugauaccggaaauggaucaaauauuuaccgaagucgaaaugaccacccucgaaaaggugauaaacgaaacgugggcguggaaaaacgccaccuuagcggaacaagccaaauuaccggcgaccgaaaaaccgguccucuugagcaaggauaucgaggccaaaaugauggcguuagauagggaaguccaauacuuauugaacaaagcgaaauucacgaaaccgagaccgagaccgaaagauaaaaacggcacgagagccgaaccgccguugaacgcgucggcgucggaucaaggcgaaaaagugauaccgccggccgggcaaaccgaggacgccgaaccgaucagcgagccggaaaaggucgaaaccgggagugaaccgggggauaccgaaccgcucgaacucggggggccgggggccgagccggagcaaaaggagcagagcaccgggcaaaaaagaccgcucaaaaaugaugaguugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5646 - RNA, 2416 nt, Artificial Sequence
  mRNA product Design1 comprising derived and/or modified sequence from Homo sapiens__NP_005339.3 __HsHSP90AA1 (opt10)
gggagaaagcuuaccaugccggaggagacgcaaacgcaggaucagccgauggaggaagaggagguagagacauucgcauuccaggcggagauagcacaauuaaugucguuaauaauuaacacguucuacaguaacaaggagauauucuuaagggaguuaauaucgaacucgucggacgcguuggacaaaauacgauacgaaucguuaacggacccgucgaaguuagacucggguaaggaguugcacaucaacuuaauuccgaacaagcaggaccggacguuaacgauaguagacacggguauaggaaugacgaaagcggacuugauaaacaacuuaggaacgauagcgaagucggguacuaaggcguucauggaggcauuacaggcgggugcggacauaaguaugauaggucaauucggggucggauucuacucggcauacuuagucgcagagaagguaacgguaaucacgaagcacaacgacgacgaacaauacgccugggagaguucggcgggugguaguuucacgguacgcacugacacgggugagccgauggguagggguacgaagguaauauuacacuuaaaggaggaccagacggaauacuuagaggagcgccggaucaaggagauuguuaaaaagcacucgcaauucaucggcuacccuauaacguuauucgucgagaaggagcgcgacaaggagguuagugacgacgaggcggaggagaaagaggacaaggaggaggagaaggaaaaggaggagaaggagucggaggacaagccggagauagaggacguaggaucggacgaggaggaggagaagaaggacggggacaaaaagaagaagaaaaagauaaaggagaaauacauagaccaagaggaguuaaacaagacgaagccgaucuggacaaggaacccggacgacauaacgaacgaggaguacggugaguucuacaagucguuaacaaacgacugggaggaccacuuagcggucaaacacuucaguguagaggggcaguuagaguuccgcgcguuguuauucguaccgaggcgcgcgccguucgacuuauucgagaaccggaagaagaaaaacaauauaaaguuauacguccgaaggguauucauaauggacaacugcgaggaguuaauuccggaguaccucaacuucauacgcggugucgucgacucggaagacuugccguuaaacaucucgcgagagauguuacagcagucgaagaucuuaaagguaauacgcaagaacuuagucaagaagugcuuagaguuauucacggaguuggcagaggacaaggagaauuacaaaaaauucuacgagcaguucucgaagaauauaaaguuagggauacacgaggacagucagaaccgaaaaaaguuaucagaauuauuacgauacuauacgagugcgucgggggacgaaauggucaguuugaaggacuauuguacacggaugaaggaaaaccaaaagcacauauacuacauaacgggggagacgaaggaccaaguugcgaacucggcauucgucgagcgcuuacggaagcacggguuagaggucauauacaugaucgaaccuauagacgaguauugcguacagcaauugaaggaguucgaggggaagacauuaguaaguguaacaaaggagggguuagaguugccggaggacgaggaggagaagaagaagcaggaggagaagaagacgaaguucgagaacuuaugcaagauaaugaaggacauauuagagaagaaggucgagaaggucgucgucucuaacagguugguaacgucgccgugcugcauaguaacgucgacuuacgguuggacugcgaacauggaacgaauaaugaaggcgcaggcguuaagggacaacaguacgauggguuacauggcggcaaagaagcauuuagaaaucaacccggaccacucgaucauagagacguuacgacagaaggcggaggcggacaagaacgacaagagugucaaagacuuaguaauauuauuauacgagacggcguuguuaucgaguggguucucguuagaggacccacaaacucacgcgaaccgaauauaucgcaugauaaaguugggauuaggaaucgacgaggacgacccgacggcggacgacacaucggcggccguaaccgaggagaugccgccguuagagggugacgacgauacuucgcggauggaggagguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5647 - RNA, 2392 nt, Artificial Sequence
  mRNA product Design1 comprising derived and/or modified sequence from Homo sapiens__NP_031381.2__HsHSP90AB1 (opt10)
gggagaaagcuuaccaugccggaggagguccaucauggcgaggaagagguggagacguuugcguuucaagcggaaaucgcgcaguugaugucgcucauaaucaauacguuuuauaguaauaaggagauauuuuugcgcgaacucaucagcaaugccucggaugcguuagauaaaauccgcuaugagucguugaccgauccgagcaaguuagauagcgggaaagaacucaagaucgauauaauaccgaauccgcaggagaggaccuugacguuggucgauacggggaucgggaugaccaaggcggauuugaucaauaacuuggggaccaucgcgaaaucgggcaccaaggcguuuauggaagcguugcaggccggggcggauaucucgaugauagggcaguuuggggucggguuuuauucggccuauuugguggcggagaaagucgucgucauaaccaagcauaaugaugaugagcaguaugcgugggagucgucggcggggggcucguuuaccgugcgcgccgaucauggggagccgaucgggaggggcaccaaggucauauugcauuugaaagaggaucagacggaguaucucgaggaaaggcgcgugaaagagguggugaagaagcauucgcaauuuauaggguauccgaucacguuguauuuagagaaggaacgcgagaaagagaucucggaugaugaagcggaagaggagaagggggagaaggaggaggaggauaaggaugaugaggagaaaccgaaaauagaggaugucgggucggaugaggaggaugauagcgggaaagauaaaaagaagaagaccaagaagauaaaggaaaaguauauagaucaggaggaauuaaauaagaccaagccgauauggacgcgcaauccggacgauauaacccaggaggaguauggcgaguuuuauaagagcuugaccaaugauugggaagaucauuuggccgucaaacauuuuucggucgaggggcaguuggaguuucgcgccuuguuguuuauaccgcgccgcgccccguuugauuuauuugagaauaaaaagaagaagaauaauaucaaauuguaugugaggaggguguuuaucauggauagcugugaugaguuaauaccggaguauuugaauuuuauaagaggggucgucgauagugaggauuugccguugaauauaucgagggagauguugcagcaaucgaaaaucuuaaaggucauacgcaagaauauagucaagaaauguuuggaguuguuuucggagcucgccgaagacaaggagaauuauaaaaaguuuuaugaggcguuuucgaaaaauuugaaguuagggauccaugaggauucgacgaacaggcgcagguugucggaguuguugcgcuaucauaccucgcaaucgggggaugaaaugaccucguugagugaguaugucucgagaaugaaggagacccagaaaagcaucuauuauauaacgggggaaucgaaagagcaggucgccaauagcgccuuuguggagagggucaggaaaaggggguuugagguggucuauaugaccgaaccgauagaugaauauugcguccagcaauugaaggaguuugaugggaagucguuggugagcgucacgaaggagggguuggagcucccggaggaugaggaggaaaaaaagaagauggaggagagcaaggcgaaguuugaaaaucucuguaaauuaaugaaggaaauauuggauaagaaagucgagaaagugaccauaagcaauagauuagucucgagcccguguuguauagugaccucgaccuauggguggaccgccaauauggagaggaucaugaaggcccaggcguugcgcgauaauagcacgaugggcuauaugauggcgaaaaagcauuuggagaucaauccggaucauccgaucgucgagaccuugcgccagaaagcggaggccgauaagaaugauaaggcggucaaggauuuggucguguuauuguuugagaccgcguuguugagcucgggguucagcuuagaagauccgcagacgcauucgaaucgcauauauaggaugaucaaauugggguuagggaucgaugaagaugaggucgcggccgaggaaccgaaugccgccgugccggaugagauacccccguuagagggcgaugaagaugccagccgcauggaggaaguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5648 - RNA, 2629 nt, Artificial Sequence
  mRNA product Design1 comprising derived and/or modified sequence from Homo sapiens__NP_003290.1__HsHSP90B1 (opt10)
gggagaaagcuuaccaugcgcgcguugugggucuuggguuuguguugugucuuguugacauuugggagcgugagggccgaugaugaaguggauguagaugggaccguggaggaagauuuggggaagucgagggaggggucgagaaccgacgaugaagugguacaaagggaagaggaagccauccaauuggacggguugaaugcgucgcaaaucagggaauugagagaaaaaucggagaaauucgcguuucaggcggaggugaaucgcaugaugaaguugauuauaaauaguuuguauaagaacaaggaaaucuuuuuaagagaguugauaaguaaugcgucggacgcgcucgacaaaaucagguugauaucguuaaccgaugagaacgcgcucucgggcaaugaagaguugacggucaagaucaaaugugauaaagaaaaaaauuuauugcacgucaccgauacaggggucgggaugacgagggaggaauuggugaagaauuuggggacgaucgcgaaaucggggaccucggaauuuuugaauaagaugaccgaagcgcaagaggaugggcaaagcaccucggaauugaucgggcaauuuggcgucggcuuuuauucggccuuuuuggucgccgauaaagucaucgugaccucgaagcauaauaaugacacgcaacauauuugggaaagcgauucgaaugaguucucggucauagccgaucccagagggaauaccuuggggcgcgggacgacgauaaccuuggucuugaaagaggaagccagcgauuauuuggaguuagauaccauaaagaauuuggucaaaaaguacucgcaauuuauuaauuuucccaucuauguguggucgagcaaaaccgagaccgucgaagaaccuauggaagaagaagaagccgcgaaggaggaaaaggaggagagcgacgaugaggccgccguggaagaggaggaagaggaaaagaaaccgaaaacgaaaaaggucgaaaagacggucugggauugggaguugaugaacgauauuaagccgaucuggcaaaggcccucgaaggagguggaagaggaugaauauaaggcguuuuauaaaucguuuucgaaagagucggacgauccuauggcguacauccauuucaccgcggagggggaagucaccuuuaagucgauauuguuugugccuaccucggcgccgcgcggguuguucgaugaguauggcucgaaaaaaucggauuauauaaaguuguauguaaggagagucuuuauuacggaugauuuucaugauaugaugccgaaauauuuaaauuucgugaaaggggucgucgacagcgacgauuuaccguugaacgucucgcgcgaaaccuugcaacaacauaaguuauugaaagucaucaggaaaaaauuggugcgcaagaccuuggauaugauaaaaaaaaucgccgacgacaaauauaacgauaccuuuuggaaggaauuugggacaaauauuaaguugggggucauagaggaucauucgaacaggacccgcuuggccaaguuguugcgcuuucaaucgucgcaccauccgaccgauaucaccucguuagaucaauacgucgagaggaugaaagagaagcaagauaagauauauuuuauggccgggaguucgaggaaggaagccgagucgucgccguucgucgaaagguuguugaaaaaaggguacgaggugauauaucucacggagccggucgaugaguauuguauacaagcguugccggaauuugaugggaaacgcuuucaaaacguggccaaagagggggucaaauuugaugagucggaaaaaaccaaagaaagccgcgaggccguggaaaaggaauuugaaccguuauugaauuggaugaaggauaaggcauugaaagauaaaaucgagaaagccgucgucagccaaagauuaacggaaucgccgugcgcguugguggcaucgcaauauggguggucggguaauauggaacgcauaaugaaagcccaagcguaucaaaccgggaaagauauaucgacgaauuauuaugcgucgcaaaaaaaaaccuuugagauaaauccgcgccaucccuugauucgcgauauguugaggcgcauaaaagaggaugaagacgauaaaacggucuuggauuuggcaguagucuuguuugagaccgcgaccuugcgcucgggguauuuauugccggauaccaaggcguauggggauaggauagagaggauguugcgcuugucguugaauaucgauccggacgccaaagucgaggaagaaccggaagaagaaccggaggaaaccgccgaagauacgacggaagauaccgaacaagaugaagacgaagaaauggacguagggaccgaugaggaagaggagacggccaaagagagcacggccgagaaagaugaguugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5649 - RNA, 2332 nt, Artificial Sequence
  mRNA product Design1 comprising derived and/or modified sequence from Homo sapiens__NP_057376.2__HsTRAP1 (opt10)
gggagaaagcuuaccauggcgagggagcucagggcguuguuguugugggggaggagguugaggccguuguugagggcgccggccuuggcggccgugccgggggggaagccgaucuuguguccgaggcgcaccaccgcccaguuggggccgaggaggaauccggcguggagcuugcaagcggggagguuguuuaguacccagacggcggaggauaaggaggagccguugcauucgaucauaucgucgacggaaaguguccaggggucgacgaguaagcaugaauuucaagcggagacgaaaaaguuguuggauauagucgcgaggucguuguauagugagaaggagguguuuauaagggaguugauaagcaaugccagugaugccuuggagaaguugaggcauaaguuggucagcgaugggcaggccuugccggagauggagauccacuugcagacgaaugccgagaaggggacgaucaccauccaggauaccgggaucgggaugacccaagaagaguuggugagcaauuuggggaccaucgcgaggucggggucgaaggcguuuuuggaugcguugcagaaucaggcggaggcgaguaguaagauaauagggcaauuuggggucggguuuuacagugcguuuauggucgccgauaggguggaggucuacagcaggagcgccgcgccggggaguuugggguaucagugguugagugaugggucgggggucuuugagaucgccgaggcgagcggggugaggaccgggacgaagauaauaauccauuugaagucggauuguaaggaguucucgagcgaggcgagggugagggauguggugacgaaguacagcaacuuugugagcuucccguuguacuugaaugggcgcaggaugaauaccuugcaggcgauauggaugauggauccgaaggaugugagggaguggcaacacgaggaauuuuauagguaugucgcccaggcccaugauaagccgagguauacguugcauuauaagaccgaugcgccguugaauauaaggaguauauuuuauguccccgauaugaagccgucgauguuugaugucaguagggaguuggggagcagcgucgccuuguauagccgcaagguguugauccagaccaaggcgacggauauauugccgaagugguugagguuuauacgcggggugguggauucggaggauauaccguugaauuugagcagggaguuguugcaggagagugcgcucauaaggaaguugagggaugucuugcagcaaagguugaucaaguuuuuuauagaccagaguaaaaaggacgccgagaaguaugcgaaguuuuuugaggauuauggguuguuuaugagagaggggauagucaccgccacggaacaggaagugaaggaagauaucgccaaguuguugcgcuaugaaaguucggcguugccgagcgggcaguugaccucguugucggaguaugcgagcaggaugcgcgccgggacgaggaauauauauuauuugugugcgccgaauaggcauuuggccgagcauagcccguauuaugaagcgaugaagaaaaaggauacggagguguuauuuuguuucgagcaguuugaugaguuaacguuguugcauuugcgcgaauuugauaagaaaaaguugauaucgguggaaaccgauauaguggucgaucauuauaaggaggagaaguuugaagauaggucgccggcggccgaguguuugagcgagaaggagacggaggaguugauggcguggaugagaaauguguuggggagucgcgucacgaaugucaaggugaccuugcgcuuggauacgcauccggcgauggugacggucuuggagaugggggccgcgaggcauuuuuugaggaugcagcaguuggccaagacccaagaagagagggcgcaguuguugcagccgacguuggagaucaauccgaggcaugcguugaucaaaaaguugaaccaguuacgcgcgagugaaccgggguuggcgcaguuguugguggaucaaauauaugagaaugcgaugauagccgccggguuggucgaugauccgagggcgauggucgggagguugaacgaguuguuggugaaggccuuggaaaggcacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5650 - RNA, 679 nt, Artificial Sequence
  mRNA product Design1 comprising derived and/or modified sequence from Homo sapiens__NP_000609.1__HsIGF1 (opt10)
gggagaaagcuuaccauggguaagaucucgucauuaccgacgcaguuguucaagugcugcuucugcgacuucuuaaagguaaagaugcacacgaugucgaguucccacuuauucuacuuggccuuaugcuuguugacguucaccuccucggcgaccgcagggccggagaccuugugcggcgcggaguuaguagacgcguuacaguucgucugcggugaccgagguuucuacuucaacaagccgacggguuacggguccucgucgcgccgugcaccgcagacgggcaucguugacgaaugcugcuuccguucuugcgaccuccgucgcuuagagauguacugcgcgccguugaagccggcgaagucggcccguucgguacgcgcgcagcggcacacggacaugccaaagacgcagaaagagguccacuuaaagaacgcgucgcguggaucggccggcaacaagaacuaccggaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5651 - RNA, 760 nt, Artificial Sequence
  mRNA product Design1 comprising derived and/or modified sequence from Homo sapiens__NP_000603.1__HsIGF2 (opt10)
gggagaaagcuuaccaugggcauacccauggguaagucaauguugguguuauuaaccuucuuagccuucgccucgugcugcaucgcggccuaccguccgucagagacccuaugcggcggggagcuaguagacacgcuacaguucgugugcggcgaccggggguucuacuucucgcgccccgcgucgcgcgugucccgccguucgcgcggcaucguagaggagugcugcuuccgaucaugcgacuuggccuuauuagagaccuacugcgccaccccggccaagucggagcgagacgugucgacgccgccgaccguguuaccggacaacuucccccgguaccccgucggcaaguucuuccaguacgacacguggaagcagucgacucagagacuucgucgcggguuaccggcguuguugcgugcccgacgaggccacgugcuagccaaggaguuagaggcguuccgcgaggcgaagcggcaccgcccguuaaucgcguuacccacucaggaccccgcgcacggaggcgccccgcccgagauggcgucgaaccgaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5652 - RNA, 856 nt, Artificial Sequence
  mRNA product Design1 comprising derived and/or modified sequence from Homo sapiens__NP_000591.1__HsIL6 (opt10)
gggagaaagcuuaccaugaacucguucaguacgucggcguucggccccgucgcguucucguuagguuuguuauuggucuuaccggcggcguucccagcgcccguuccaccgggugaggacucgaaggacguugcggcgccccaccgacagcccuugaccucguccgagcguaucgacaagcagauccgauacaucuuagacgguauaagugcguuacgcaaggagacgugcaacaaaucgaacaugugcgagaguucgaaggaggcguuagccgagaacaaccucaacuugccgaagauggcggagaaggacgggugcuuccagaguggguucaacgaggagacaugcuuaguaaagaucauaacgggccuccuugaguucgaggucuaccucgaguacuuacagaacagguucgagucaucggaggagcaggcacgcgcgguucaaaugucgacgaagguauugauccaguuccuccagaagaaggccaagaacuuagacgcgaucacgacgccggacccgacuaccaacgcgaguuuguuaacuaaguuacaggcgcagaaccagugguugcaggacaugaccacccacuugaucuugcggucguucaaggaguucuugcagaguucuuuaagagcguuaaggcagaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5653 - RNA, 1498 nt, Artificial Sequence
  mRNA product Design1 comprising derived and/or modified sequence from Homo sapiens__NP_002183.1__HsINHBA (opt10)
gggagaaagcuuaccaugccguuauugugguuaaggggguucuuguuagcgucgugcuggaucaucgugcguucgucgccgacgcccgggucggagggucacucggccgcaccggacugcccaaguugcgcacuugccgcguuaccgaaggacguuccgaacucgcagccggagaugguugaggccgugaaaaagcacauauugaacauguuacaccuaaagaagcgaccggacguaacgcagccgguccccaaagcggcccuauuaaacgcuauacggaaguuacacguugggaagguaggcgagaacgguuacguggagaucgaggacgacaucgggcgccgcgccgagaugaacgaguuaauggagcagacgucagagaucaucaccuucgcggagucgggcacugcgcguaagacuuugcacuucgagaucucgaaggaggguucggacuuaucggugguagagcgggccgaggugugguuauucuugaaggugccgaaggcgaaccgaacgcgaaccaaggucaccauccgauuguuccagcaacagaaacacccccaggggaguuuagacaccggggaggaggccgaggagguaggucucaagggggagcgauccgagcuccucuuaucggagaagguggucgacgcgcgaaagucuacguggcacguauucccggugucgucgucgauccagcgccuacuugaccagggcaagaguucguuggacguccgcauagcgugcgagcagugccaggagucgggcgcgucucuuguauuguuagggaagaagaagaagaaggaggaggagggugaggggaagaagaaggggggcggggagggcggggcgggcgcggacgaggagaaggagcagucucaccggccguucuuaauguuacaagcgcgucaaucggaggaccacccgcaccgacgacgccgacguggguuagagugcgacggcaaggugaacaucugcugcaagaagcaguucuucguuucauucaaggacaucgguuggaacgacuggauaauagccccgucgggguaccacgcgaacuacugcgagggcgagugcccgucccacaucgccgguacuucgggcucgucguuaucguuccacaguacgguuauaaaccauuaccguaugcguggacacucccccuucgcgaacuugaagaguugcugcgugccgaccaaguugcgucccaugucgaugcuuuacuacgacgacggccagaacauuauaaagaaggacauccagaacaugaucgucgaggaaugcggcugcaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5654 - RNA, 1441 nt, Artificial Sequence
  mRNA product Design1 comprising derived and/or modified sequence from Homo sapiens__NP_002184.2__HsINHBB (opt10)
gggagaaagcuuaccauggacgguuuaccgggacgagcuuugggugcggcuuguuuguuauuguuggcagcggguugguuaggcccggaagcguggggaucgccgacaccucccccuacuccggcggcgccaccgcccccgccaccgccggggucgccaggcgggucccaagauacuugcacaaguugcggggguuuccgacgacccgaggaauugggacgcguagacggugauuucuuggaagcuguaaagcgucauaucuuaucgcguuuacagaugcgagggcgaccgaacauaacccacgccguaccgaaggcggcgaugguuaccgcguuacgaaaguuacaugcugggaagguucgugaggacgggcguguagagaucccccauuuggacgggcacgccucgccaggggccgacgggcaagagcgagucucggagauaauuaguuucgcggagacugacggguuagcgucgucgaggguacguuuauacuucuucauaucgaacgaggguaaccaaaacuuguucguaguacaggcgaguuuaugguuauaccuuaagcuauuaccauacguuuuagagaaggggucgcgucgaaaaguaaggguaaagguauacuuccaagagcaaggucacggcgaccgauggaacaugguagagaagcggguugaccuuaagcgaaguggauggcacacguucccguuaacugaggcaauacaggcauuauucgagcguggagagcgccgcuuaaacuuagacguacaaugcgacucgugccaggaguuggcagucgucccaguauucguagaccccggggaggagagucaucgaccguucguaguaguacaggcgcgcuuaggugacucgcgacaccgaauccggaagcgugguuuagagugcgacgguaggacgaacuugugcugccgacagcaguuuuuuauagacuuuagguugaucggguggaacgacuggauaauugcgccgacaggauacuacgguaacuauugcgaaggaaguugcccggcguacuuagcgggggugccagguucggcaucgucguuccacacugcgguaguuaaccaguaccgaaugcgaggauugaauccggggacaguaaacucgugcugcaucccgacgaaguuaaguacgaugucgauguuauacuucgacgacgaguacaacauaguaaagcgcgacgucccgaacaugaucguagaagagugcgguugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5655 - RNA, 3676 nt, Artificial Sequence
  mRNA product Design1 comprising derived and/or modified sequence from Homo sapiens__NP_000623.2__HsITGAM (opt10)
gggagaaagcuuaccauggcguugaggguccucuuauugaccgccuugaccuuaugccauggguuuaauuuggauacggagaacgccaugacguuucaggagaaugccaggggguuugggcagagcgucgugcaguugcaggggagcagggucguggugggggcgccgcaggaaaucguggccgccaaucagagggggagcuuguaucagugugauuauagcacgggcagcugugagccgauacgcuuacaggugccgguggaggccgugaauaugucguuaggguugucguuggcggcgaccacgagcccgccgcaguugcucgccugugggccgacggugcaccaaacguguagcgagaauacguaugucaagggguuguguuucuuguucggcaguaauuugaggcaacaaccgcagaaguuuccggaggcguugagggggugcccccaggaggauucggauaucgcguucuugaucgaugggagugggaguaucaucccgcaugauuuuaggagaaugaaagaguucgugagcaccgucauggagcaguugaaaaagaguaagaccuuguuuaguuuaaugcaguauucggaagaauuucgcauacauuuuacguuuaaggaauuucaaaauaauccgaauccgaggagcuuagucaagccgaucacccaguuguuggggcgcacccauaccgcgaccgggauacgcaaaguggucagggaguuguuuaauaucaccaacggggccaggaagaaugcguuuaagauauuggucgugaucacggauggggagaaguuuggcgauccgcucggguaugaggaugucauaccggaggccgaucgcgaaggggucauaagguaugugauaggggucggcgaugcguuuaggucggagaagaguaggcaagaguugaauaccaucgcgaguaagcccccgagggaucauguguuucaggugaauaauuuugaggcguugaagacgauacagaaucaguugagggaaaagaucuuugcgaucgaggggacgcagacggggucgaguucgaguuuugagcacgagaugagucaggagggguuuucggcggccauaacgaguaaugggccguuguugagcacgguggggagcuaugauugggccggggggguguuuuuguauacgaguaaagagaagaguaccuuuauaaauaugacgcgcguggacagcgauaugaaugaugccuacuugggguaugcggccgccauaaucuugaggaaucgcguccagagcuugguccucggggcgccgagguaucagcauauaggguuggucgccauguuuaggcagaauacgggcaugugggagucgaaugccaaugugaaagggacgcagauaggggccuauuuuggggccagcuuguguagcgucgauguggauagcaaugggucgaccgacuuggucuugauaggggccccgcauuauuacgaacaaaccaggggggggcaggucagcgugugcccguugccgagggggagggcgagguggcagugugaugccgucuuguacggggagcaggggcagccgugggggcgcuuuggggcggccuugacgguguugggggaugugaauggggauaaguugacggaugucgccauaggggccccgggggaagaggauaauaggggggccgucuauuuguuucaugggacgagugggucggggauaagcccgagucauagccagaggaucgcggggagcaaguuaaguccgcgcuuacaguauuuuggccagucguugaguggggggcaggauuugaccauggauggguuggucgacuuaaccgucggggcccagggccacgucuuguuguugaggagucagccggucuugagggugaaagccauaauggaauuuaacccgagagagguggccaggaauguguuugaguguaaugaucaggucgugaaagggaaggaggcgggggaggugcgcgucugcuuacauguccagaaaucgaccagggacagguuaagggaggggcagauacaaagugucgugacguaugauuuggcguuggauagugggcgcccgcauucgagggcgguguuuaaugagacgaagaacagcacgaggagacagacgcaagucuugggguugacgcagaccugugaaaccuugaaguugcaguuaccgaauugcauagaggauccggugagcccgauagucuugagguugaacuucaguuugguggggaccccguugagcgccuuugggaauuugaggccgguguuggcggaggaugcgcagagguuguuuacggcguuguuuccguuugagaaaaauugugggaaugauaauaucugccaggaugauuugucgauaacguuuagcuuuaugagcuuggauuguuuggucgucggggggccgagggaguucaaugugaccgugacgguccgcaaugauggggaagacaguuaucgcacccaggucaccuuuuuuuuucccuuggauuugagcuauaggaaggugagcacguugcagaaucagaggagccagaggagcuggcgcuuggccugcgagagcgcgagcagcaccgaggucucgggggcguuaaagagcacgaguugcaguaucaaucauccgauauuuccggaaaauucggaggugaccuuuaauaucaccuuugaugucgauagcaaggccagcuuggggaauaaguugcucuuaaaggcgaaugugacgucggagaauaauaugccgcgcaccaauaagaccgaauuucaguuggaguugccggugaaauacgcggucuauaugguggugacgucgcauggggucaguaccaaguauuugaauuucacggcgucggagaauaccagucgcgucaugcagcaucaguaucaagucaguaauuuggggcagaggucguugccgauaaguuuggucuuuuuggucccggugcgcuugaaucaaaccgucaucugggauaggccgcaggucaccuuuagcgagaauuugaguaguaccugccauaccaaggagagguugccgucgcacagugauuucuuggccgaauugaggaaggcgccggucgucaauuguagcauagccgucugucaaaggauccaaugugauaucccguuuuucggcauccaagaggaauuuaaugccaccuugaaggggaauuugucguuugauugguacauaaaaacgagccacaaucauuuguugaucgucaguaccgcggagauauuguuuaaugauucgguguuuacccucuuaccggggcagggggccuuugucaggagccaaaccgagaccaaggucgagccguuugaggugcccaaucccuugcccuugauaguggggaguagugucgggggcuuguuguuguuggcguugauaaccgccgccuuauacaaauugggguuuuuuaaaaggcaguauaaggacaugaugagugagggggggcccccgggcgcggagccgcaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5656 - RNA, 1621 nt, Artificial Sequence
  mRNA product Design1 comprising derived and/or modified sequence from Homo sapiens__NP_002415.1__HsMMP8 (opt10)
gggagaaagcuuaccauguuuaguuuaaaaaccuugccguucuuauugcucuugcacguccaaaucaguaaagcguucccggucagcagcaaggaaaagaacaccaagaccguccaagauuauuuagagaaauuuuaucagcucccgucgaaucaauaccaaagcacccgcaaaaacgggaccaacgucauagucgagaaauugaaggagaugcaaagguucuucggccucaacgucaccggcaaaccgaacgaagagaccuuagauaugaugaagaaaccgaggugcggggucccggauucggggggguucaugcucacgccggggaauccgaaaugggagaggaccaaucucacguaucgcaucaggaauuacacgccgcaauuaagcgaagccgaagucgagcgcgccauaaaagacgcguucgaguuguggucggucgccagcccguugauauuuacgcgcauaagccaaggggaagccgacauaaauaucgccuucuaucagcgcgaccauggggauaacagcccguucgacgggccgaacgggauauuggcccacgcguuccaaccggggcaggggaucgggggggacgcccacuucgacgcggaggagaccuggacgaauacgagugccaacuauaaucucuucuuggucgccgcccacgaguucgggcacagccucggcuuggcccauaguagcgauccgggggcgcucauguacccgaauuacgccuuucgcgagacgucgaauuauagcuugccgcaggacgauauagacgggauccaagcgauauacggguugagcucgaauccgauacagccgaccgggccgucgaccccgaagccgugcgauccgucgcucaccuucgacgccauaacgaccuugaggggggagaucuuguuuuucaaggaucgcuauuuuuggcgccgccacccgcaauugcagcgcguggagaugaacuucaucagcuuguuuuggccgaguuugccgaccgggauccaagccgccuacgaggacuucgaucgcgauuugaucuuuuuguucaaggggaaucaguauugggccuuaucgggguacgacaucuuacagggguacccgaaagacaucagcaauuacggguuuccgucgucggugcaggccaucgaugccgccgucuuuuaucgcucgaagaccuauuuuuucgucaacgaucaguuuuggcgcuacgacaaucagcgccaguuuauggaaccgggguacccgaagucgaucagcggggcguucccggggaucgaaucgaaggucgacgccgucuuucaacaggagcacuuuuuucacguguuuucggggccgcgcuacuaugccuucgacuugaucgcccaacgcgucacgcgcgucgcccgcgggaacaagugguugaauugccgcuacgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5657 - RNA, 2341 nt, Artificial Sequence
  mRNA product Design1 comprising derived and/or modified sequence from Homo sapiens__NP_004985.2__HsMMP9 (opt10)
gggagaaagcuuaccaugucguuauggcaaccuuugguauugguauuauuggucuuagggugcugcuucgcagcgccgcgucagcgacagucgacauuagucuuguucccgggugacuuacgaaccaacuuaacugaucggcaauuagcugaagaguauuuauacagguacggcuacacgcgcguagcggagaugaggggggagucuaagaguuuaggcccagcauuacucuuguugcagaaacaguuaucguuacccgaaacgggggaauuagacucggcgacacucaaggcgaugcgcacuccucguugcggaguacccgacuugggacgauuucagacauucgagggugauuugaaguggcaccaccacaacauaacguacuggauccagaacuacucugaggacuuaccucgugcaguaauagacgacgcuuucgcacgagcguucgcuuuauggucggccguuacacccuugacguuuacgcgagucuauucgcgcgacgccgacauaguaauacaguucgggguagccgagcacggugacggcuacccauucgacgguaaggacgguuuauuagcgcacgcguucccgccggggccggguauccagggcgacgcgcacuucgacgacgacgaauuauggucuuuagggaaagggguaguuguaccuacgcguuucgguaacgcggacggugccgcaugccauuucccguucauauucgaggggcgaucauauagugcgugcacuacggacggacggucggacggguuacccugguguucgacuacugcgaacuacgacacggacgaccgauucgguuucugcccgucggagcguuuauacacgcaagacgguaacgcggacggcaagccuugccaguucccuuucauauuccagggacagucguacucggcaugcacaaccgacgggcggucggacggguaccgguggugcgcgacuacggcgaacuacgaucgcgacaaguuauucggguucugcccaacacgggcagacucuaccguaaugggagggaacagugccggagaguugugcguauuccccuucacguucuugggaaaagaguacucaacaugcacuucggaaggccggggugacggucgauuguggugcgccacuacgaguaacuucgacucggacaaaaagugggguuucuguccugaccagggcuauucguuauucuuaguagcagcacacgaguucgggcacgcauuaggauuggaccacaguaguguacccgaagcauugauguauccgauguaccgauuuacggaagguccgccguuacacaaggacgacguaaacgguauccgacacuuauacggcccacggccggagccggaaccgcgcccaccgaccacaacgacuccacagcccacugcaccgcccacaguauguccuacggguccuccgacaguacacccgucggagcgaccgacggcaggucccacuggaccgccgagugcagggccgacggggccgccgaccgcagguccgucgacggcgacaacggucccguuaucgcccguagacgacgcgugcaacguuaacauauucgacgcaauagcagagauagguaaccaguuauacuuauucaaggacggcaaguacuggcgcuuuucggaggggcgaggaagucgaccccaggggccguucuuaaucgcggacaaguggccggcauuaccucgaaaguuagauucaguauucgaggagcgauuaaguaagaaauuauucuucuucucggguaggcaaguauggguauauacgggugccuccguauuagggccccggaggcucgacaaguuggggcucggugcugacgucgcgcagguaacgggugcuuuacgcucgggucgaggaaagauguuauuauucaguggucgccgauuauggcguuucgacguaaaggcacagauggucgacccucgaucggcgucggaggucgaccguauguucccggguguaccguuagacacacacgacguauuccaguaccgcgaaaaggcuuacuucugccaggauagguucuacuggcgagucucgucgaggucggaauuaaaucaaguagaccagguaggguaugucacguacgacaucuuacagugcccggaggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5658 - RNA, 1633 nt, Artificial Sequence
  mRNA product Design1 comprising derived and/or modified sequence from Homo sapiens__NP_002418.1__HsMMP13 (opt10)
gggagaaagcuuaccaugcacccgggcguguuagccgcguuuuuguuucucucguggacccacugcagagcguuaccguugccgucggggggggacgaggacgaccucagcgaagaggauuugcaauucgccgaaagguauuuacgcagcuauuaucacccgaccaacuuggccgggauauuaaaagaaaacgccgccucgaguaugaccgaacgcuugagggagaugcaaaguuuuuuugggcucgaagucaccgggaaguuggaugacaauacgcucgacgugaugaagaaaccgcgcuguggcgucccggacgucggggaguauaacgucuuuccgaggaccuugaaguggaguaagaugaaccucacguaucgcaucgucaacuauacgccggacaugacccacagcgagguggagaaagccuuuaagaaggcguuuaaggucuggagugacgucaccccguuaaacuucacgcgcuugcaugacgggaucgccgauauaaugauuagcuucgggaucaaagaacacggggauuuuuauccguucgacggcccgagcggguuauuagcccacgccuucccgccgggcccgaacuacgggggggacgcgcacuucgacgacgacgagacguggaccucgucgaguaagggguauaaucucuucuuggucgccgcccacgaauuugggcauagucucggguuggaucauaguaaagauccgggggccuugauguucccgauauauacguauacggggaagucgcauuucauguugccggacgaugacguccagggcauacaaaguuuguacgggccgggggacgaggauccgaauccgaagcacccgaagaccccggauaagugcgauccgagucucaguuuggacgcgaucacgucguugaggggggagaccaugauauucaaggaucgcuuuuuuuggagguuacacccgcaacaagucgacgccgaauuauuccucaccaagagcuucuggccggaguugccgaauaggaucgacgccgccuacgaacauccgagccacgauuugauauuuauauuucgcgggcgcaaguucugggccuugaacggguacgauaucuuagagggguacccgaagaagaucagcgaguuaggguugccgaaggaggucaaaaaaaucucggccgccguccauuucgaagacaccgggaaaaccuuguuauuuagcgggaaucaaguguggcgcuacgacgacaccaaucacaucauggacaaggauuacccccgcuugaucgaggaggauuuuccggggaucggggacaaggucgacgccguguacgaaaagaacggguacauauacuucuuuaaugggccgauccaauucgaguauucgauauggucgaauaggaucgucagggugaugccggccaacaguauccucuggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5659 - RNA, 1285 nt, Artificial Sequence
  mRNA product Design1 comprising derived and/or modified sequence from Homo sapiens__NP_001286.1__HsCCR1 (opt10)
gggagaaagcuuaccauggaaaccccgaacaccaccgaagauuacgacaccacaaccgaguucgacuacggcgacgccacccccugccaaaaagucaacgaacgcgccuucggcgcccaacuccucccaccccuuuacucccucgucuucgucaucggccucgucggcaauauccucguaguccucguccucguccaauacaaacgacucaaaaacaugaccuccaucuacuuacucaacuuagccaucuccgaccuccucuuccucuucacccuccccuucuggauagacuacaaacucaaagacgacugggucuucggcgacgccaugugcaaaauccucucgggcuucuacuacacaggacucuacuccgaaaucuucuucaucauccucuuaacuaucgaccgcuaccuagccaucguccacgccgucuucgcacuacgcgcccgcaccguaaccuucggcgucaucaccucaaucaucaucugggcccucgccauccucgccuccaugcccggccucuacuucucaaaaacccaaugggaguucacacaccacacaugcucacuccacuucccccacgaauccuuacgcgaauggaaacucuuccaagcccucaaacucaaccuauucggccuaguccucccacuacucgucaugaucaucugcuacacaggcaucaucaaaauacuccuccgccgccccaacgaaaagaaauccaaagcaguccgccucaucuuugucauaaugauaaucuucuuccuauucuggacccccuacaaccucaccauccucaucucaguauuccaagacuuccucuucacccaugaaugcgaacaaucacgccacuuagaccucgccguccaagucaccgaggucauugccuacacccacugcugcgucaacccaguaaucuacgccuucgucggcgaacgcuuccgcaaauaccuccgucaacuauuccaccgacgcgucgccguacaccucgucaaauggcuccccuuccuaucugucgaccgauuagaacgcgucuccuccacaagcccaagcaccggcgaacacgaacucuccgccggcuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5660 - RNA, 853 nt, Artificial Sequence
  mRNA product Design1 comprising derived and/or modified sequence from Homo sapiens__NP_002598.4__HsPDGFA (opt10)
gggagaaagcuuaccaugcgaacauuagcaugcuuguuguuauuagguugcggguacuuagcgcacguguuagcagaggaggcagagaucccgcgugagguuaucgagcgcuuggcacgaucgcagauccacaguauccgagacuuacagcgguuguuggagaucgacucagucggcucggaggacucguuagacacgaguuuacgagcgcacggggugcacgccacgaagcacguaccggagaagcgcccguugccgauacgucgcaagcgaucgaucgaggaggcggugcccgcgguuugcaagacgcgaaccgucaucuacgagaucccacgaucgcagguagacccuaccucggcuaacuucuuaauauggccuccaugcguagaggucaagcguugcacggggugcugcaacacaucgucgguuaagugccagccgucgcgagugcaccaccguucgguaaagguggccaagguugaguacguacgaaagaagcccaagcuaaaggagguucagguucgauuggaggagcacuuagagugcgcuugcgccacgacgaguuugaaccccgacuaccgugaggaggacacggggcgaccgcgcgagucgggcaagaagcgaaagcgaaagcgguugaagccgacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5661 - RNA, 943 nt, Artificial Sequence
  mRNA product Design1 comprising derived and/or modified sequence from Homo sapiens__NP_002599.1__HsPDGFB (opt10)
gggagaaagcuuaccaugaaccguugcugggcccuuuucuugucguuaugcugcuacuugcgcuuggugucggccgagggugauccgauaccggaggagcuguacgagaugcuaucugaccacaguauaaggucauucgacgacuugcagcgauuauuacacggggacccgggugaagaggacggggcggaguuagacuuaaacaugacgcgcucgcacucggguggggaguuggagucguuagcgcgggggcggcgaucguuagggucguugacgaucgcggagccugcgaugaucgcggagugcaagacgcguacggaggucuucgagauaucgcgacguuuaaucgaccgaaccaacgcaaacuucuuaguauggcccccuugcgucgagguacagaggugcaguggaugcugcaacaaccgaaacguccagugcaggccgacgcagguucaguugcguccgguacaaguccguaagaucgagaucguccguaagaagccgauauucaagaaggcuacgguaaccuuagaggaccaucucgccugcaagugcgagacugucgccgcggcgaggccgguaacucggucgcccggugggagucaggagcagcgugcgaagacgccgcagacgcgaguuaccauaaggaccguacgugugcgucguccgccgaaaggaaagcaccgaaaguucaagcacacgcacgacaagacugccuuaaaggagacguuaggugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5662 - RNA, 1255 nt, Artificial Sequence
  mRNA product Design1 comprising derived and/or modified sequence from Homo sapiens__NP_057289.1__HsPDGFC (opt10)
gggagaaagcuuaccaugucguuauucggcuuguuauuauugacgagugcguuagcagggcagcggcaagguacacaggcagagucgaaccucucgucgaaguuccaguucucgucgaacaaggagcagaacggugugcaggacccacagcacgagcguaucaucacgguuucgacaaacgggucgauacacucgccgcguuucccacacacguacccgcgaaacacuguguuagucuggcgucucguugccgucgaggagaacguuuggauccaguuaacuuucgacgagagguucgguuuagaggacccggaggacgacaucugcaaguacgacuucguugagguagaggagccuucagacgguacgaucuugggacgauggugcgggucggggaccguucccgggaagcagauaucgaaggggaaccagauacgaauccgauucgucucggacgaguacuucccgucggagccggguuucugcauacacuacaacauaguaaugccgcaguucacggaggccguuucgccgucugucuuaccgcccucggcguuaccguuagacuuacucaacaacgcgaucacggcguucucuacguuagaggacuuaauacguuacuuagagccggagcgauggcaauuagacuuggaggacuuguaccgccccaccuggcaguuacucgguaaggcauucguauucgggcgaaagagucgaguaguagacuuaaauuuauuaaccgaggagguucgacuauacucuugcacuccccgcaacuucucgguuucgauccgagaggagcuuaagcgcacggacacgauauucuggccggggugcuuauuggucaagaggugcggggguaacugcgcgugcugccuucacaacugcaacgagugccagugcgugccgucgaaggucacaaagaaguaccacgaggucuuacaacuucgccccaagacgggcgugcgagguuuacacaagagucuaacugacguagcgcucgagcaccacgaggagugcgacugcgucugcagggggucgaccggggggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5663 - RNA, 1312 nt, Artificial Sequence
  mRNA product Design1 comprising derived and/or modified sequence from Homo sapiens__NP_149126.1__HsPDGFD (opt10)
gggagaaagcuuaccaugcaccgacuaaucuucguauacaccuugauaugcgccaacuucugcuccugccgagacacgucggccacuccccagucggcuaguauaaaggcccuucguaacgcgaacuugcgucgggacgaccuuuacaggagggacgagacuauccaggucaagggcaacggauacguccaaucgccccgguuccccaacaguuacccgcggaacuuacuuuugaccuggcguuuacacucgcaggagaacacgaggauccaauuaguuuucgacaaccaguucggccucgaggaggccgagaacgacauaugccgauacgacuucguagagguagaggacaucagugagaccucgacgauaaucagggggcgguggugcggccacaaggagguacccccucgaaucaagagucgaaccaaccagaucaagauaaccuucaagucggacgacuacuucguagcaaagccgggguucaagauauacuacucgcucuuagaggacuuccagccggcggccgcgucggagacaaacugggagucgguaacgucgucgauaucgggugugucguacaacucacccucggucaccgacccgaccuugauagccgacgcguuagacaagaagaucgccgaguucgacacgguagaggacuuguugaaguacuucaacccggagucguggcaggaggacuuagagaacauguacuuagacacgccgagguacagggggcggucguaccacgaccgcaagucgaagguggacuuagaccgacuuaacgacgacgcgaagcgauacucgugcacaccucgaaacuacaguguaaacaucagggaggaguuaaaguuagccaacgucguauucuucccgcggugcuuauuaguucagcguugcgggggcaacugcgguugcgggacggugaacuggcgaucuugcacgugcaacucggguaagaccguaaagaaguaccacgagguccuucaguucgagcccgggcacauaaagcgucgcggccgugcgaagaccauggcgcucguggacauucaacucgaccaccacgagcguugcgacugcaucugcucgucgcgaccuccgcguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5664 - RNA, 895 nt, Artificial Sequence
  mRNA product Design1 comprising derived and/or modified sequence from Homo sapiens__NP_003946.3__HsSOCS3 (opt10)
gggagaaagcuuaccaugguaacgcacucgaaguucccggcggcggguaugaguaggccguuagacacaucgcuucguuuaaagacauucucgucgaagagugaauaccagcucguugucaacgcgguccggaaguugcaagaaucagguuucuauuggucggcgguaacggggggggaggcaaauuuauuauugucggcggagccagcggggacauucuuaauccgugacucgucugaccagcggcacuuuuuuacauuaucagugaagacacaaucggguacgaagaaccuucgaauacagugcgagggcggaaguuucucguugcagagugacccgcgaucuacacagccggucccucgauucgacugcguauuaaaguugguucaccauuacaugcccccaccgggggcuccgaguuucccgucaccgccgacggagccgaguucggagguaccggagcagccaucggcgcagccuuuaccggguucgccgccucgacgcgcguacuacauauacucggggggugaaaagauuccacucguauuaucgaggccuuuaucgucgaacguagcgacacuccaacacuugugccgcaagaccguuaacggacauuuagacucguacgagaaggucacgcaacucccaggcccgaucagggaguucuuggaccaguacgacgcuccauuaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5665 - RNA, 700 nt, Artificial Sequence
  mRNA product Design1 comprising derived and/or modified sequence from Homo sapiens__NP_003227.1__HsTGFA (opt10)
gggagaaagcuuaccauggugccgagcgccgggcaauuggcguuauuugccuuagggaucguccucgccgccugucaagcgcucgaaaauucgaccagucccuuaucggccgaucccccggucgccgccgccgucgucagucacuucaacgauuguccggacagucauacccaauuuuguuuucacgggacgugucgcuuccucguccaagaagauaaaccggccugcgugugucacagcggcuaugucggggccaggugcgaacacgccgauuuguuagcggucgucgccgcgucgcaaaaaaaacaagcgauaacggcgcucgucgucgugaguauagucgcguuagccguguugauaauaaccugcgucuuaauccauuguugucaagugaggaagcauugcgaaugguguagagcguugauauguagacaugaaaaaccgucggcguuguuaaaagggcgcacggccuguugucauagcgagaccgucgugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5666 - RNA, 1390 nt, Artificial Sequence
  mRNA product Design1 comprising derived and/or modified sequence from Homo sapiens__NP_000651.3__HsTGFB1 (opt10)
gggagaaagcuuaccaugcccccgucugguuuacgauuauuacccuuauuguuacccuuauugugguuauuaguauugacccccgggcgaccggccgccggcuuaaguacgugcaagaccaucgacauggaguuaguaaagcggaagcgaauagaggcgauacgagggcagaucuuaucgaaguuacgauuagccaguccgcccucgcagggcgagguaccgcccgggcccuugcccgaggccguauuagcguuauacaacaguacccgagaccgaguagcgggugagucugcggagcccgagcccgagcccgaggccgacuacuacgccaaggagguaacacgaguauugaugguagagacccacaacgagaucuacgacaaguucaagcagaguacgcacucuaucuacauguucuucaacacgagugaguuacgagaggcgguucccgagcccguauuauuaagucgagcggaguuacgauuauugcgauuaaaguuaaagguagagcagcacguagaguuauaccagaaguacaguaacaacucuuggcgauacuuaucaaaccguuuauuagcgccgucugacagucccgagugguuaucuuucgacguaacggggguaguacgacagugguuaagucgugggggcgagauagagggguuccgauugucagcgcacugcaguugcgacucucgggacaacacguugcagguagacaucaacggcuucacgacggggcgacgaggcgacuuagccaccauacacggcaugaaccgacccuucuuauuauuaauggccacgcccuuagagcgugcgcagcacuuacagucuagucgacaccgacgagccuuagacaccaacuacugcuucaguucgaccgagaagaacugcugcguacgacaguuauacaucgacuuccgaaaggacuuaggguggaaguggauacacgagccgaagggcuaccacgcgaacuucugcuuagggcccugccccuacaucuggucguuagacacgcaguacaguaagguauuagccuuauacaaccagcacaaccccggcgccucggcggccccgugcugcguaccgcaggcguuggagcccuuacccauaguauacuacguaggccguaagccgaagguagagcaguuaaguaacaugauaguacgaucgugcaagugcaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5667 - RNA, 1462 nt, Artificial Sequence
  mRNA product Design1 comprising derived and/or modified sequence from Homo sapiens__NP_003229.1__HsTGFB2 (opt10)
gggagaaagcuuaccaugcacuacugcguauuaucugcguucuugauauuacacuuaguuaccguggcauugaguuuauccacuugcaguacguuagacauggaccaguucaugcgaaagcgaauagaggcuauaaggggucagauuuugucgaagcucaaguuaacgucuccuccggaggacuaccccgagccggaagagguaccgccggagguaaucaguauauacaacucgacgcgagaccuuuuacaggaaaaggcaucgcgacgcgcagcggcgugcgagagggagcguucggacgaggaguacuacgcgaaggaaguauacaagaucgacaugccuccguucuucccgucggagaacgcgaucccaccuacguucuaucgaccguacuuccgcaucgucagguucgacguaagugcgauggagaagaacgccucuaacuuaguaaaggcggaguuucgaguauucagguuacagaacccgaaggcgcgaguucccgagcagaggaucgaguuauaccagaucuuaaagaguaaggaccuuacuucgccuacgcaacgauacauagacaguaagguaguaaagacgcgagccgagggagagugguuaucguucgacgucacggacgcgguccacgagugguuacaccacaaggaccgcaaccuuggcuucaagaucagucuccacugcccgugcugcacauucgucccuucgaacaacuauauaauaccgaacaagucggaggaguuagaggcucguuucgcgggaaucgacgggacgucgacguacacgucgggagaccagaagacgaucaagucgacgcgaaagaagaacucgggaaagacaccgcacuuguuauuaauguuguuaccgucguacagguuagagucgcagcagacgaaccgccgaaagaagcgagcgcuagacgcagcguacuguuuccgaaacguacaagacaacugcuguuuaaggcccuuauacaucgacuucaagcgcgacuuggguuggaaguggauccacgagccuaaggguuauaacgcaaacuucugcgcaggcgcgugccccuaccucuggucgucggacacccaacacagucgaguguuaucucuuuacaacacgaucaaccccgaggcgagugccucgccgugcugcgucucgcaggacuuggagccauuaacgaucuuguacuacaucgguaagacgccuaagaucgagcaguuaucgaacaugauagucaaaaguugcaagugcucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5668 - RNA, 1456 nt, Artificial Sequence
  mRNA product Design1 comprising derived and/or modified sequence from Homo sapiens__NP_003230.1__HsTGFB3 (opt10)
gggagaaagcuuaccaugaagaugcacuugcagagggcguugguaguauuagcguuauugaacuucgcgacgguaucguuaaguuuaucgacaugcacgacguuggacuucggccacaucaagaagaagcgcguagaggcgauacggggucagauauuaaguaaguuacgcuugacgucgccgccggagccgacgguaaugacacacguaccguaccagguauuagcguuauacaacaguacgagggaguuguuagaggagaugcacggugagcgcgaggaggguugcacgcaggagaacacggagucggaguacuacgcgaaggagauacacaaguucgacaugauacaggguuuagcggagcacaacgaguuggcgguaugccccaaggggauaacgaguaaggucuucagguucaacguaucgaguguagagaagaaccgcacgaacuuauucagggcggaguuccgaguauuaagggucccgaacccgucgaguaagcgaaacgagcagaggauagaguuauuccagauauuacgccccgacgagcacauagcgaagcagcgguacauaggggguaagaacuuacccacgcgcgguacggcugagugguugucguucgacguaacagacacgguaagggagugguuauuacgcagggagaguaacuugggcuuagagauaucgauacacugcccuugccacacguuccagccgaacggggacauauuagagaacauacacgagguaauggagauaaaguucaaggguguagacaacgaggacgaccacgggcgaggggacuuggggagguuaaagaagcagaaggaccaccacaacccccacuuaauauugaugaugauaccgccgcaccgauuagacaaccccggucagggggggcagcgaaagaagagggcguuagacacgaacuacugcuuccgaaacuuggaggagaacugcugcguaaggccguuauacauagacuuccgccaggacuuaggguggaaguggguacacgagccgaaggguuacuacgcuaacuucugcagugguccgugccccuacuugaggucggcagacacaacgcacaguacgguauuagguuuauacaacacguugaacccggaggcgucggcuaguccgugcugcguaccgcaggacuuagagcccuuaacaauauuguacuacguagggagaacgccgaagguagagcaguuaucgaacaugguaguaaagucgugcaagugcaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5669 - RNA, 1603 nt, Artificial Sequence
  mRNA product Design1 comprising derived and/or modified sequence from Homo sapiens__NP_001057.1__HsTNFRSF1B (opt10)
gggagaaagcuuaccauggccccgguggcggucugggcggcuuuagcgguagggcuugagcuuugggcggccgcgcacgcguuaccggcgcaggucgcguucacgcccuacgcucccgagccggguucaacgugcagguugcgcgaguacuacgaccaaacugcgcagaugugcugcucgaagugcuccccgggacagcacgcgaagguauucugcaccaaaacaucagacacggugugcgacucgugcgaggacucgacuuacacgcaauuauggaacugggugcccgagugccucucgugcggaucgcgaugcucgucagaccaaguagagacccaggccugcacgcgcgagcaaaaccggaucugcacgugccgcccgggcugguacugcgccuugucgaagcaggaggguugccgacucugcgcgccccuccgaaagugccggccggguuucgggguagcgcgaccugggacggagacgucggacguagucugcaagccgugcgcgcccggaacauucucuaacacgacaucgucuaccgacaucugccgcccgcaccagaucugcaacgucguugcaaucccggggaacgcgaguauggacgcgguaugcacaucgacgucgccgacgcgcucaauggcgccgggcgccgugcaccuuccgcagcccguaucgacgcggucgcagcacacccaaccgacgccggagccgucgaccgcgccgucgacuucguuccuuuuacccauggggcccucgccgcccgcggagggcucgaccggugacuucgcguugccgguaggguuaaucgugggcgucacggcguuaggguuguuaaucaucggcgucguaaacugcgugauaaugacgcagguaaagaagaagccgcugugcuugcagcgagaggcgaaggugccgcacuuaccggccgacaaggcccguggcacgcagggucccgagcagcagcacuuauuaauuaccgcgccgucgucgaguucgaguucguuggagucgagcgcaucggcccuagacaggcgagcccccacgcgaaaccagccgcaggcgccggguguggaggcgucuggggccggcgaggcccgugccucgaccggaucgucggacucgucgccgggcggacacgguacacagguaaacguaacuugcaucguuaacguaugcucgucgucggaccacucgagucagugcucgagucaggcgucgucgacgaugggggacacugacucgucgcccucagagaguccuaaggacgagcaggucccguucucgaaggaggagugcgccuuccguagucaacucgagacaccggagacgcuccucggaucaacggaggagaagccguuacccuuaggcguuccggacgcggggaugaagccgucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5670 - RNA, 730 nt, Artificial Sequence
  mRNA product Design1 comprising derived and/or modified sequence from Homo sapiens__NP_002623.2__HsPGF (opt10)
gggagaaagcuuaccaugcccguaaugcgcuuauuuccauguuucuugcaguuauuagcgggcuuggccuuacccgcaguaccaccgcaacaaugggcucucucggcagggaacgguaguucggaaguugaggucgucccguuccaggaggucuggggucgaaguuacugcagggcccuugagcgccucguggacguaguaagugaguauccgagugagguagagcauauguucucgccuaguugcguuucuuuauugagguguacagguugcugcggugacgagaacuuacacugcguacccguagagaccgccaacguaacuaugcaauuauugaagauucgaucgggagaccguccaucguacguagaguuaaccuuuagucagcauguccguugcgagugccguccgcuucgcgagaaaaugaagcccgagcgucgaaggccuaaagggcgcgggaagcggcgcagggagaaacagcgaccuacggacugucacuugugcggggacgcggucccgcgacgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5671 - RNA, 1456 nt, Artificial Sequence
  mRNA product Design1 comprising derived and/or modified sequence from Homo sapiens__NP_001020537.2__HsVEGFA (opt10)
gggagaaagcuuaccaugaccgaccgccagaccgacacggcccccucgccguccuaccaccucuuacccggccggcgccggaccguggacgccgcggccucgcgcgggcagggccccgagcccgcccccgggggcggggucgagggcgugggcgcccgcgggguggccuuaaaguuauucguccagcucuuaggcugcucccgguucgggggcgcgguggugcgggccggggaggccgagcccucgggcgccgcgcgcuccgccucguccggccgggaggagccccagcccgaggagggggaggaggaggaggagaaggaggaggagcgcggcccgcaguggcgguuaggggcccgcaagcccggcucguggaccggcgaggccgccgucugcgcggacuccgcccccgccgcccgggccccgcaggcgcucgcccgcgccucggggcggggcgggcgcguggcccggcgcggcgccgaggaguccgggccgccccacucgcccucccggcgcggcucggcgucccgggccggccccgggcgcgccucggagaccaugaacuucuuauuauccugggugcacuggucgcucgccuuauuacucuacuuacaccacgccaaguggucccaggcggccccgauggccgagggcgggggccagaaccaccacgaggucgugaaguucauggacguguaccagcgcucguacugccaccccaucgagacguuagucgacaucuuccaggaguaccccgacgagaucgaguacaucuucaagcccucgugcgugccgcucaugcggugcgggggcugcugcaacgacgagggcuuagagugcgugcccaccgaggaguccaacaucaccaugcagaucaugcgcaucaagccccaccaggggcagcacaucggcgagaugucguucuuacagcacaacaagugcgagugccggcccaagaaggaccgcgcccggcaggagaagaaguccguccgcgggaagggcaaggggcagaagcggaagcgcaagaagucccgguacaagucguggucgguguacgugggcgcgcgcugcugccucaugccgugguccuuacccggcccccaccccugcgggccgugcucggagcggcgcaagcacuuauucguccaggacccgcagacgugcaagugcucgugcaagaacacggacucgcggugcaaggcgcgccagcucgaguuaaacgagcggacgugccgcugcgacaagccgcggcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5672 - RNA, 916 nt, Artificial Sequence
  mRNA product Design1 comprising derived and/or modified sequence from Homo sapiens__NP_001165094.1__HsVEGFA (opt10)
gggagaaagcuuaccaugaacuucuuauugucguggguccacuggaguuuagcguuauuguuauacuuacaccacgcgaaguggucgcaagcagcgccgauggcggagggggguggucaaaaccaccacgagguaguaaaguucauggacguguaccagaggucguacugccacccgauagagacguugguagacauauuccaagaguacccggacgagaucgaguacaucuucaagccgucgugcguaccguuaaugcgcugcggugguugcugcaacgacgaggguuuagagugcgucccuacggaggagaguaacaucacuaugcagauaaugaggauuaagccgcaucaagggcagcacauaggggagaugucguucuugcagcauaacaagugcgagugccgaccgaagaaggaccgagcgcgacaggagaagaagaguguaagggguaaagggaagggucaaaagcgcaagaggaaaaagagucgauacaagucguggucgguauacgucggggccaggugcugcuuaaugccguggucguuaccagggccgcacccgugcgggccgugcucggagcgcaggaagcacuuauucguacaggacccacagacgugcaagugcaguugcaagaacacggacucgcguugcaaggcacgacaguuagaguuaaacgagcgaacgugccggugcgacaagccucgaaggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5673 - RNA, 841 nt, Artificial Sequence
  mRNA product Design1 comprising derived and/or modified sequence from Homo sapiens__NP_003368.1__HsVEGFB (opt10)
gggagaaagcuuaccaugucgccguuauugaggagguuauuauuggcggccuuguuacaauuagcgccggcgcaagcgccggugagucaaccggacgcgccggggcaucaacgcaaggucgucagcuggaucgacgucuacaccagggccacgugucaaccgagagaagucgucgucccgcucaccgucgaauugauggggacggucgcgaagcaauuagucccgucgugugucaccguccaaaggugcgggggguguuguccggaugacggguuagaaugcgucccgaccggccaacaucaggugagaaugcaaauauugaugauaagauaucccucgucgcaauuaggcgaaaugaguuuagaggagcauucgcaaugcgagugucgcccgaagaagaaagauucggccgucaaaccggaucgcgccgcgaccccgcaucauaggccgcaaccgaggagcguccccgggugggauagcgcgccgggggccccgaguccggccgauauaacgcacccgaccccggcgccggggccgagcgcgcaugccgccccgucgacgacgucggcguuaacgccggggccggcggccgcggccgcggaugcggccgccaguagugucgcgaaagggggcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5674 - RNA, 1477 nt, Artificial Sequence
  mRNA product Design1 comprising derived and/or modified sequence from Homo sapiens__NP_005420.1__HsVEGFC (opt10)
gggagaaagcuuaccaugcaccucuuaggguucuucagcgucgccugcuccuuacuggcggcggcccuccugcccgggccgcgcgaggccccggcggcggcggcggcguucgagagcggccuggaccucuccgacgccgagccggacgcgggggaggcgaccgccuacgccucgaaggacuuagaggagcagcugcgguccgucagcuccguggacgagcucaugaccgugcuguaccccgaguacuggaagauguacaagugccaguugcgcaagggcggguggcagcacaaccgggagcaggcgaaccucaacagccgcacggaggagaccaucaaguucgcggccgcccacuacaacaccgagauccucaaguccaucgacaacgaguggcggaagacccagugcaugccgcgcgaagucugcaucgacgucggcaaagaguucggcguggccacgaauacguuuuucaagccgcccugcgucaguguguaucggugcgggggcuguuguaacuccgaaggguuacaauguaugaauacgucgaccucguauuuaucgaaaacgcuguucgagaucaccguccccuugucccaggggccgaagcccgucaccauaucguucgcgaaccauaccucgugucgcuguaugagcaaguuagacguguaucgccaggugcacucgaucauccggcggaguuuacccgcgacguugccccaaugccaagccgccaauaaaacguguccgacgaacuauauguggaacaaccauauaugucgcuguuuagcccaagaggacuucauguucaguuccgacgccggggacgauagcaccgacggcuuucacgauauaugcggccccaauaaagaauuagacgaggaaacgugccaaugcgucugucgggcgggguugcgccccgcgucgugcggcccgcauaaggagcucgaucggaauagcugucaaugcgugugcaagaauaaguuguuuccgucgcagugcggggcgaaucgcgaguucgacgagaauacgugucaaugcgugugcaagcggacguguccgcgcaaccagccguugaaccccggcaagugcgcgugcgagugcaccgagucgccgcaaaagugucuccugaagggcaagaaauuucaucaucagaccuguucgugcuaucggcgccccugcaccaaucggcaaaaagccugcgaacccggguucagcuacuccgaggaggucugccgcugcgugcccagcuacuggaagcgcccgcagaugucgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5675 - RNA, 1282 nt, Artificial Sequence
  mRNA product Design1 comprising derived and/or modified sequence from Homo sapiens__NP_004460.1__HsVEGFD (opt10)
gggagaaagcuuaccauguacagggaaugggucguagucaacgucuucaugauguuauacguacaauuaguacaagguucgucgaacgagcacgguccggucaagcguucgucgcaaucgacguuagagcguucggagcagcagauacgagcggcgucgucguuagaggaguugcuacggauaacgcacucggaggacuggaaguuauggcgaugucgauuacgcuuaaagucguucacaucgauggacucgaggucggcuucgcaccgcucgacgcgguucgccgcgacauucuacgacauagagacguuaaaggucaucgacgaggaguggcagcgcacgcagugcucgccgagggagacuugcgucgaggucgcgucagaauuggguaagucgacuaacacguuuuucaagccuccgugcguuaacgucuuccguugcggggguugcugcaacgaggagucguuaaucugcaugaacacaaguacgucauacaucucgaagcaauuauucgagaucucggucccauuaaccucggucccggaguuggugccgguaaagguagcgaaccacacggggugcaagugcuuaccgacggcuccgcgacacccguacaguauaauacgacggucgauacagauucccgaggaggaccgaugcagucacucgaagaagcuaugcccaaucgacaugcucugggacaguaacaagugcaagugcguauuacaggaggagaaccccuuggcggggacggaggaccacucgcacuugcaggagccggcguugugcggaccgcacaugauguucgacgaggaccggugcgagugcguaugcaagacuccgugcccgaaggacuugauucagcacccuaagaacugcucgugcuucgaaugcaaggagucguuagagacgugcugccagaagcacaaguuguuccacccggauacaugcaguugcgaggaccgaugcccguuccacacacgacccugcgcgucggguaagacggcuugcgcgaagcacugccgauucccuaaggagaagcgagcggcacaggguccgcacucucguaagaacccgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5676 - RNA, 865 nt, Artificial Sequence
  mRNA product Design1 comprising derived and/or modified sequence from Homo sapiens__NP_002119.1__HsHMGB1 (opt10)
gggagaaagcuuaccauggguaaaggugacccgaaaaagccacgcgguaagaugaguucguaugcguucuucguccaaacgugccgagaggaacacaagaaaaagcacccggacgcgucgguaaacuucucggaguucucaaaaaagugcuccgaacgcuggaagacgaugucggcgaaagagaaagguaaauuugaagauauggcgaaagcggacaaggcgcgcuacgagagggagaugaagacauauauaccgccgaagggugagaccaagaaaaaguucaaggacccgaacgcgccgaagcggccgccgucugcguuuuuccuuuucuguucggaguaccgcccgaagauaaagggagagcacccgggccuuucgauaggcgacguagcgaaaaaguugggugaaauguggaauaacacggcggcggacgauaaacagccauaugaaaagaaagcagcgaagcucaaggaaaaguacgagaaagauaucgcggcauaucgagcaaaagguaaaccggacgcggcgaagaaagguguaguaaaagcagaaaagucgaagaaaaagaaagaggaagaggaagaugaagaggacgaggaagaugaagaggaagaggaagaugaagaggacgaggacgaggaagaggacgaugacgaugaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5677 - RNA, 1012 nt, Artificial Sequence
  mRNA product Design2 comprising derived and/or modified sequence from Homo sapiens__NP_061986.1__HsFGF21 (opt10)
ggggcgcugccuacggagguggcagccaucuccuucucggcaucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5678 - RNA, 1792 nt, Artificial Sequence
  mRNA product Design2 comprising derived and/or modified sequence from Homo sapiens__NP_002412.1__HsMMP1 (opt10)
ggggcgcugccuacggagguggcagccaucuccuucucggcaucaagcuuaccaugcauucguucccgccguuauuauuauuauuauuuuggggggucgucagccauucguuuccggccaccuuggagacccaggaacaggacgucgaucucgugcaaaaguauuuagagaaguauuauaauuuaaaaaacgacggccgccaggucgagaaaagacgcaacucggggccggucgucgagaagcucaaacagaugcaagaguuuuucggcuuaaaggucaccggcaagccggacgccgagacguuaaaagucaugaaacaaccgcgcugcggggucccggacgucgcccaauucguguugaccgaaggcaauccgaggugggaacagacccacuuaacguaucgcaucgagaacuauaccccggaccucccgcgcgccgacgucgaucacgcgaucgaaaaggcguuucaguuguggucgaacgugaccccguuaaccuuuacgaaagugagcgaagggcaggccgauauaaugaucagcuucgugcgcggggaccacagagauaauagcccguucgacgggccgggggggaacuuggcccacgccuuccagccggggccggggaucgggggcgacgcccacuucgacgaggacgagcgcuggacgaauaacuuucgcgaauauaaucuccacagggucgccgcccacgaguuggggcacagcuugggguugagucacagcaccgacauaggcgcccucauguauccgucguauacguuuucgggggacguccaauuggcccaagacgauaucgacgggauacaggcgaucuacgggaggagucagaacccggugcaaccgauagggccgcagacgccgaaggccugcgauucgaaauugacguucgacgccaucaccaccaucagaggggaggucauguuuuucaaggaucgcuuuuauaugaggaccaacccguuuuaucccgaggucgaauugaacuuuaucagcgucuuuuggccgcaguuaccgaacggcuuggaggccgccuaugaguucgcggaucgcgacgaggugagauucuuuaagggcaacaaauauugggccguccaagggcaaaacgucuugcauggguauccgaaagauauauauucgaguuucggguuuccgcgcaccgucaaacacauagacgccgccuugagcgaagagaauaccgggaagacguauuuuuucgucgccaauaaguauuggcgcuacgacgaguacaagaggagcauggacccgggguacccgaagaugaucgcccacgauuucccggggaucgggcauaaggucgacgccgucuuuaugaaggacggguucuuuuacuuuuuccacgggacccgccaguauaaguucgacccgaagaccaaacgcauccucaccuugcaaaaggccaacucgugguuuaauugucgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5679 - RNA, 3448 nt, Artificial Sequence; identical to SEQ ID NO: 3528
  mRNA product Design2 comprising derived and/or modified sequence from Clostridium histolyticum__BAA34542.1__ColH (opt10)

SEQ ID NO: 5680 - RNA, 2569 nt, Artificial Sequence
  mRNA product Design2 comprising derived and/or modified sequence from Homo sapiens__NP_000592.3__HsHGF (opt10)
ggggcgcugccuacggagguggcagccaucuccuucucggcaucaagcuuaccaugugggucacgaaguuguuaccggcguuauuauuacaacacguguuguuacacuuguuguuauugccgauagcgauaccguaugccgaagggcagcgcaagcgccgcaauaccauccacgaguuuaagaagagugccaaaaccacguugauaaagaucgacccggccuuaaaaaucaagacgaaaaaggucaacaccgccgaucagugcgccaaccgcugcacccgcaacaagggguugccguuuaccuguaaagccuucgucuucgacaaggcccgcaagcaauguuugugguuuccguuuaacucgaugagcucgggggucaagaaggaguucgggcacgaguucgauuuguaugagaauaaggauuauauccgcaauuguauaaucgggaaagggaggucguauaaagggaccgucagcauaaccaaaucggggauaaaaugccaaccguggucgaguaugaucccgcaugagcauucguuccucccgagcucguacagagggaaggauuugcaagagaauuauugcaggaacccgaggggcgaggagggcgggccguggugcuuuaccucgaacccggaagucagguaugaggugugcgauaucccgcaaugcagcgaggucgaguguaugacguguaacggcgaaucguacaggggguugauggaccacaccgagagcgggaaaaucugccaaaggugggaccaccaaaccccgcauagacauaaauuucucccggagcgcuauccggauaaaggguucgacgacaacuacuguaggaacccggacgggcaaccccgcccgugguguuauaccuuggauccgcauacgaggugggaauauugcgccaucaaaaccugugccgauaacaccaugaacgauaccgacgucccgcucgagaccaccgaguguauacaggggcagggggagggguaucgcgggaccgugaacacgaucuggaacgggaucccgugccaaaggugggacagccaauauccgcaugaacacgauaugaccccggagaacuuuaaauguaaagauuugagggagaacuauuguaggaacccggacggcagcgagagcccguggugcuucacgaccgacccgaauauaagggucggguauuguagucagaucccgaauugcgacaugagccacgggcaagacugcuauaggggcaacgggaaaaacuacauggggaaucucagucagacccgcagcggguugaccugcagcaugugggauaaaaauauggaggaucuccacaggcacauauuuugggagccggacgccucgaaauuaaacgaaaacuauuguaggaacccggacgacgacgcccacgggccgugguguuauaccgggaacccguugaucccgugggacuauuguccgaucaguaggugcgagggggacacgaccccgaccaucgugaaccucgaucacccggucaucagcugcgcgaagaccaagcagcucagggucgucaacggcaucccgaccaggaccaauaucggguggauggucucgcuccgcuaucgcaacaagcacauauguggggggagccucaucaaagaaucgugggucuugaccgccaggcaaugcuuuccgagcagggaucucaaggacuacgaggccugguuggggauccacgacgugcaugggcgcggggacgaaaaguguaagcaagucuugaacgucagucaauuagucuacgggccggaggggagcgacuuaguccucaugaaauuggcgcgcccggccguguuagacgacuucgucucgaccaucgaccucccgaauuacggguguaccaucccggagaaaacgucguguucggucuauggguggggguauaccgggcucauaaauuacgacggguugcucagggucgcccacuuguauaucauggggaacgaaaaguguucgcaacaccacaggggcaaagucaccuuaaacgaaagcgagaucugcgccggcgccgagaaaaucgggagcgggccgugcgaaggcgacuauggggggccguuggucugcgaacagcacaaaaugcgcauggucuugggggugaucgucccggggagggggugcgcgaucccgaacaggccggggaucuucgugagggucgccuacuacgccaaguggauccauaagaucauccucaccuauaaagucccgcaaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5681 - RNA, 958 nt, Artificial Sequence
  mRNA product Design2 comprising derived and/or modified sequence from Homo sapiens__NP_001133.1__HsAMELX (opt10)
ggggcgcugccuacggagguggcagccaucuccuucucggcaucaagcuuaccauggguacguggauacucuucgcgugcuuguuaggugcggcguucgcgaugccguuaccgccgcacccaggccacccgggauacaucaacuucucguacgaggucuuaacgccgcucaagugguaccagaguauccgaccuccuuaccccucguacggauacgagccgaugggggguugguuacaccaccagauaauaccaguauugagucagcaacacccgccaacgcacacuuuacagccgcaccaccacauccccguaguccccgcgcagcaaccggucaucccgcaacagccgaugaugccgguacccgggcagcacucgaugacaccuauccagcaccaccaaccgaacuugccgccgccggcgcagcaacccuaccagccacagccgguccagccucaaccccaccagccuaugcagccucagccgccgguacacccgaugcagccguuaccaccgcagcccccguuaccgcccauguucccgaugcaaccccucccgccgauguuaccggacuuaacguuagaggcguggccuucgacggacaagacgaagcgcgaggagguugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5682 - RNA, 517 nt, Artificial Sequence
  mRNA product Design2 comprising derived and/or modified sequence from Homo sapiens__NP_001133.1__HsAMELX-TRAP (opt10)
ggggcgcugccuacggagguggcagccaucuccuucucggcaucaagcuuaccaugccguugccgccgcauccgggucacccgggguauauaaacuucucguaugaggucuugacgccgcucaagugguaccaaucgauucgcccgccuuacccgaguuauggguacgagccgauggggggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5683 - RNA, 961 nt, Artificial Sequence
  mRNA product Design2 comprising derived and/or modified sequence from Homo sapiens__NP_001134.1__HsAMELY (opt10)
ggggcgcugccuacggagguggcagccaucuccuucucggcaucaagcuuaccauggguacauggauauuauucgcgugcuuggucggugcugcauucgcaaugccauuaccuccccacccaggccacccgggguacauuaauuucucguacgagguauuaacgccgcuuaaaugguaccagaguaugaucaggccgccguacucgucguacggauacgaacccaugggggguugguuacaucaccagauaauaccgguagucucgcagcagcacccguuaacgcacacguugcaaucgcaccaccacauaccgguaguaccggcgcagcaaccucgcguuaggcagcaggcguuaaugccgguaccggggcagcagucgaugacaccgacccagcaccaccagccgaacuuaccauuacccgcucaacagccauuccagccgcaacccguccagccgcaaccccaucagccgaugcaaccgcaaccgccgguacagccgaugcagccguuguuaccgcagccgccguugccacccauguucccguuacgcccuuuaccuccgaucuuaccggacuuacacuuagaggcauggccggcgacggacaagacgaagcaggaggagguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5684 - RNA, 520 nt, Artificial Sequence
  mRNA product Design2 comprising derived and/or modified sequence from Homo sapiens__NP_001134.1__HsAMELY-TRAP (opt10)
ggggcgcugccuacggagguggcagccaucuccuucucggcaucaagcuuaccaugccguugccgccgcacccgggccauccgggguacauaaauuuuucguacgaagucuugacgccgcucaaaugguaucaaucgaugauccgcccgccguauagcaguuacggguaugaaccgauggggggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5685 - RNA, 3343 nt, Artificial Sequence
  mRNA product Design2 comprising derived and/or modified sequence from Homo sapiens__NP_006120.1__HsBMP1 (opt10)
ggggcgcugccuacggagguggcagccaucuccuucucggcaucaagcuuaccaugcccggagucgcgcgauugccauugcucuuagguuuguuauuauuaccacgcccggggaggccccucgacuuagcggacuacacguacgacuuggcagaggaggacgacucugaaccuuuaaacuacaaggacccgugcaaggcugccgcguucuuaggggacauagcguuggacgaggaggacuuacgcgcuuuccaaguccagcaggcgguugacuuaaggcgccacacggcgcggaaaaguucgaucaaggcggcgguacccgggaacacaaguacgccgucgugccaaaguacaaacggacaaccacagcgcggggcgugcggacgguggcgagggaggucgaggaguaggcgagcagccaccucgcgucccgagcggguauggccggacgguguaauuccauucguaauagguggcaacuucacgggaagucagcgggcgguauuccgccaggcgaugcgacacugggagaaacacacaugcguuacguucuuggagcgaaccgacgaggacucguacauaguauuuacguaccguccaugcggcugcugcaguuacguagggcgaagggguggcgguccgcaagcgaucucgauagguaagaacugcgacaaguucgguaucguaguucacgaguuaggucacguuguagguuucuggcacgagcacacgcgaccugaccgcgacaggcacgucaguauaguccgcgagaacauacagccgggacaggaguacaacuucuuaaaaauggagccgcaagagguugagucguugggugagacguacgacuucgacucgauaaugcacuacgcgcgaaacacguucucgcgcgggauuuucuuagacacaauaguuccgaaauacgagguaaacggcgucaagccgccgauaggccagcggacucgcuugucgaagggugacauagcgcaggcgcggaaguuguauaagugcccggcgugcggugagacauuacaggacucgacgggaaacuuuaguucgcccgaguacccuaacggcuacucggcgcacaugcacugcgucuggcgaauaucgguaacuccgggggagaagauuauuuuaaauuucacuucauuggauuuauauaggucgcgauuauguugguacgacuacguagaaguaagggacggguuuuggcguaaggccccuuugcgugggcgauucugcggaucgaaguuaccggagccgauaguaaguacggacucgcguuuauggguagaguuccgaaguucgaguaacuggguagguaaggguuucuucgccguuuacgaggcaauaugcgguggggacguaaagaaggacuacggucauauacagucuccgaauuacccggacgacuacaggccuaguaagguauguauauggcgcauccaagucucggagggauuccauguuggguugacguuucagaguuucgagauagagaggcacgacucgugcgcguacgauuacuuagagguaagggacggacauucggagucgaguacuuuaauaggacgauacugcgguuacgagaagccggacgacauaaagucgacuucgucgcgauugugguuaaaguucguuucggacggaaguauaaacaaggcagguuucgcgguuaacuucuuuaaggagguagacgagugcucgcgaccgaaccgaggcgguugcgagcaacgaugcuuaaacacguugggaucuuacaaaugcucuugcgacccggguuacgaguuggcgccggauaagaggcgaugcgaggcggcaugcggggguuucuuaacaaaguugaacgguucgauaacaucgcccggguggccgaaggaguacccgccgaacaagaacugcauauggcaauuagucgcgccgacacaauaccggauuucguuacaguucgacuucuucgagacggaggguaacgacgucuguaaguacgacuucgucgagguccgaucggguuugacugcggacucaaaguuacacgguaaguucugcggcucggagaagccggagguaauuacaucgcaguacaacaacaugcgagucgaguucaagucggacaacacgguaaguaagaagggguucaaggcacacuucuucucggauaaggacgaguguucgaaagacaacggggguugccaacaggacugcguaaacaccuucgguucguacgagugucagugccgaucggguuucguauuacacgacaacaagcacgacugcaaggaggcaggaugcgaccauaaggucacgucgacuucggggacgauaacgucgccgaacuggccggacaaguacccgucgaagaaggagugcaccugggcgaucucgucaacuccgggucaucgaguuaaguugacguucauggagauggauauugagucgcagcccgagugcgcguacgaccacuuagagguauucgacgggcgugacgcgaaagcaccgguauuaggaagguucugcgguucgaagaaacccgaaccgguuuuggcgacgggaagucguauguucuuacgguucuacucggacaauaguguacaacguaagggguuccaagcaucgcaugcgacggagugcgguggucagguccgagcggacguuaaaacgaaagacuuauacucgcacgcgcaguucggggacaauaacuacccgggcgggguugacugcgaguggguuauagucgcagaggagggguacgguguagaguuaguauuccagacuuucgaggucgaggaggagacggacugcgguuacgacuacauggaguuauucgacgguuacgacucgacggcgccacgauuagguagguacugcgggucgggaccgccggaggagguauacucagccggugacaguguauuagucaaguuucacucugacgacacgauaacgaagaagggcuuccacuuacguuacacgaguacgaaguuccaggacacguuacacucucgaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5686 - RNA, 1573 nt, Artificial Sequence
  mRNA product Design2 comprising derived and/or modified sequence from Homo sapiens__NP_001191.1__HsBMP2 (opt10)
ggggcgcugccuacggagguggcagccaucuccuucucggcaucaagcuuaccauggucgcgggcacgagguguuuguuggcacucuuauugccgcaaguauuguuagggggggccgcgggguugguccccgaguuagggaggcgcaaguucgccgccgcaagcagcgggaggccgagcagucagccgagcgacgagguauuaucggaguucgagcucagauuauugucgauguucggguuaaaacaacgcccgacgccgucgcgcgacgcggucgucccgccguauauguuggacuuauauaggcgccacagcgggcagcccgggagcccggcgccggaccacagacucgagcgcgcggcgucgagggcgaacacggucaggucguuccaccaugaagaaagccucgaagaauugccggaaacaucgggcaaaacgacgagacgcuucuucuuuaaucucucgagcauaccgaccgaggaguuuauaacgagcgccgaguugcaagucuucagggaacagaugcaagaugcgcucgggaacaauucgucguuccaucacaggauaaauauauaugaaauaauuaaaccggccacggcgaacagcaaauucccggucacgcgcuugcucgacacgcgccucgucaaucagaaugcgucgcgcugggaaucguuugauguaacgccggcggucaugagauggaccgcccaggggcacgcgaaccauggguucgucgucgaagucgcgcaccucgaggagaaacaagggguaaguaagcgccauguccgcauuucgcgcagccuccaccaagaugaacacucguggagccagauucgcccgcucuuggucacguuugggcaugaugggaaaggccauccguugcacaaacgcgaaaaaaggcaagcgaaacacaaacaaagaaaaagguugaagaguucguguaagcgccacccgcucuacgucgacuucucggacgucgguuggaaugacuggauagucgccccgccuggcuaucacgcguuuuauugccacggggaaugcccguuuccguuagccgaucauuuaaacaguacgaaucaugcgauaguccagacacucguaaacagcgucaacagcaagauaccgaaagcgugcuguguacccacggaauugucggcgauaagcauguuauauuuggacgagaaugaaaaggucguccucaaaaauuaucaggacauggucgucgagggguguggcuguaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5687 - RNA, 1609 nt, Artificial Sequence
  mRNA product Design2 comprising derived and/or modified sequence from Homo sapiens__NP_001193.2__HsBMP4 (opt10)
ggggcgcugccuacggagguggcagccaucuccuucucggcaucaagcuuaccaugauaccgggaaacaggauguuaaugguaguauuguugugccagguauuauuggguggugccucgcacgcgaguuugaucccggagaccgguaagaagaagguagcggagauccagggccacgcggggggccgacguagcggucagucgcacgaguuauugcgagacuucgaggccacgcucuuacagauguucggucuucgccgaaggccgcagccgucuaagucggccgucauacccgacuacaugcgagacuuauaccgauuacagucgggcgaggaggaggaggagcagauccacaguacgggguuagaguacccggagcguccggccucgcgagcgaacacgguccgcucguuccaccacgaggagcacuuggagaacauaccgggcaccucggagaacagugcguucagauucuuauucaacuuaucgaguaucccagagaacgaggugauaucuagugcggaguugcgcuuauuccgugagcagguugaccaagggccggacugggagcgcggcuuccaccgaaucaacaucuacgaggugaugaagccgccggcggagguaguacccggucacuuaaucacucgucucuuagacacgcgauuaguacaccacaacguaacgaggugggagacguucgacgucaguccggcgguauugagguggacgcgcgagaagcagcccaacuacggauuagcgaucgaggucacgcaccuacaccagacccguacgcaccagggccagcacguccgaauaucgcgaucgcuaccgcagggaucggguaacugggcgcaauuaagaccguuguuaguaacguucggccacgacgggcgaggccacgcuuuaacgcgucgacgacgugcgaagcgcucgccgaagcaccacucgcagcgagcgcgaaagaagaacaagaacugccgacgucacagucuuuacguugacuucucggacgucggauggaacgacuggauaguugcgccgccgggcuaccaggcguucuacugccacggggacugcccguucccguuagccgaccacuuaaacaguaccaaccacgccaucguccagacgcuuguaaacucgguaaacaguucaauacccaaggcgugcugcguacccacggaguuaagugcgaucucgauguuauacuuggacgaguacgacaagguuguuuuaaagaacuaccaggagaugguuguggagggcugcggaugccguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5688 - RNA, 1924 nt, Artificial Sequence
  mRNA product Design2 comprising derived and/or modified sequence from Homo sapiens__NP_001709.1__HsBMP6 (opt10)
ggggcgcugccuacggagguggcagccaucuccuucucggcaucaagcuuaccaugcccggcuuaggcagacgcgcccaaugguuauguuggugguggggcuuauuauguucguguuguggcccgccccccuuaagacccccgcucccggccgcggccgcggcggcggcgggcggccaauuauuaggcgaugggggcucgccggggaggaccgaacaacccccccccagcccccaaaguaguagcggguuuuuauauagaagauugaaaacccaagaaaaaagagaaaugcaaaaagaaauacucagcgucuuaggcuugccccauagaccgagaccguuacauggguugcagcaaccccaaccgcccgccuugagacaacaagaagaacaacaacaacaacaacaauuaccgaggggggaaccgccgccgggcagguuaaaaagugccccguuguuuauguuagacuuauauaaugcguuaagugcggauaaugaugaagauggcgccagcgaaggcgaacgccaacaaaguuggccgcaugaggccgcgucgagcagucaaaggagacaacccccgcccggggcggcccaucccuugaauaggaaaucguuguuagcgccggggagcgggucggggggggccaguccguuaacgucggcccaagauucggcguuuuugaaugaugccgauauggugaugucguucgucaauuuagucgaauaugauaaagaauuuaguccgaggcaaaggcaucauaaggaauuuaaauuuaaucucagucaaaucccggaaggggaagucgucaccgccgccgaguuuaggauauauaaagauugcgucaugggcucguucaagaaucagaccuucuugauaucgaucuaccaggugcuccaagaacaccaacaucgcgauagcgauuuauuccuccucgauacgagggucgucugggcgagcgaggaggggugguuagaguucgauauaaccgcgaccucgaacuuaugggucgucaccccgcaacacaauaugggcuugcaauuaucggucgucacccgcgacggggugcaugugcauccgagggcggccggguuagucgggcgcgaugggccguaugauaaacaaccguuuauggucgccuuuuuuaaggucucggaaguccaugucaggacgacgcgcagcgcgaguucgagaaggaggcagcaaucgaggaacaggagcacgcaaagucaagaugucgccagagugaguucggccagcgacuauaauucgucggagcucaagaccgcgugucgcaaacacgaauuauacgucucguuucaggauuuaggguggcaagauuggauaaucgccccgaaaggguacgccgcgaacuauugcgacggggaguguaguuuuccguugaaugcccauaugaacgccacgaaucaugccaucguccaaacgcucguccauuugaugaauccggaauacgugccgaagcccuguugcgccccgaccaaauugaacgcgauaagcgucuuguauuucgacgauaauaguaacgugaucuuaaagaaguaucgcaacauggucguccgcgccugcgggugucauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5689 - RNA, 1678 nt, Artificial Sequence
  mRNA product Design2 comprising derived and/or modified sequence from Homo sapiens__NP_001710.1__HsBMP7 (opt10)
ggggcgcugccuacggagguggcagccaucuccuucucggcaucaagcuuaccaugcacguaagaucguuacgagcggcggcuccgcacaguuucguagcguugugggccccguuauucuuauugcgaucggcguuagcggacuucaguuuagacaacgagguacacucgaguuucauacaccgaagauugcgcucgcaggagaggcgcgagaugcagcgagagauauuaaguauauuaggguugccgcaccgacccaggccccacuugcaggggaagcacaacucggcuccaauguucauguuagacuuauacaacgcgauggcgguagaggagggggggggucccgggggucagggcuucaguuaccccuacaaggcgguauucucuacgcaggguccgccguuagcgaguuuacaggacucgcacuucuugacggacgcggacaugguaaugaguuucguaaacuuaguagagcacgacaaggaguucuuccacccgcgauaccaccacagggaguuccgauucgacuuaucgaagauacccgagggggaggcgguaacggcggcggaguucaggauauacaaggacuacauccgagagagauucgacaacgagacguuccgaauaaguguauaccagguauugcaggagcacuuagguagggagucggacuuauucuuguuagacagucgcacguuaugggcgucggaggaggguugguuggucuucgacauaacggcgacgaguaaccacugggucguaaaccccaggcacaacuuagguuuacaguugucgguagagacauuagacggucagucgauaaacccgaaguuagccggguugaucggucgacacggcccgcagaacaagcagccguucaugguagccuucuucaaggcgacggagguacacuucaggaguauaaggucgacggguaguaagcagcgaucgcagaacaggaguaagacaccaaagaaccaggaggcguuaagaauggcgaacguagcugagaacucgaguucggaccagaggcaggcgugcaagaagcacgaguuauacguaaguuuccgcgacuugggguggcaggacuggauaauagcgccggagggguacgcagcguacuacugcgagggugagugcgcguuccccuuaaacucguacaugaacgcgacgaaccacgcgauaguacagacguuaguacacuucaucaacccggagacaguaccgaagccgugcugcgcgccgacgcaguugaacgcgauaaguguauuauacuucgacgacucgaguaacguaaucuuaaagaaguacaggaacaugguaguacgagcgugcgguugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5690 - RNA, 682 nt, Artificial Sequence
  mRNA product Design2 comprising derived and/or modified sequence from Homo sapiens__NP_006264.2__HsCCL7 (opt10)
ggggcgcugccuacggagguggcagccaucuccuucucggcaucaagcuuaccaugaaggcgucggccgcguuacuaugcuuauuacuuaccgccgcggcguucucgccgcagggcuuagcgcaaccgguagguauaaacaccaguacgacaugcugcuacagguucauaaacaagaagaucccgaagcagcgauuagagaguuaccgucguacgacgagcucucacugcccgcgugaggcggucauauucaaaacgaaguuagacaaggagauaugcgcagaccccacccagaaguggguacaggacuucaugaagcacuuagacaagaagacgcagacgccuaaguugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5691 - RNA, 4006 nt, Artificial Sequence
  mRNA product Design2 comprising derived and/or modified sequence from Homo sapiens__NP_001954.2__HsEGF (opt10)
ggggcgcugccuacggagguggcagccaucuccuucucggcaucaagcuuaccauguuauugaccuugauaaucuuacucccggucgucagcaaguucucguucgucucguugagcgccccccaacauuggucgugcccggaggggaccuuggccgggaacggcaacaguaccugcgucgggccggccccguuucucaucuuuagucacgggaacucgauauuccgcaucgauaccgaggggacgaacuacgaacagcucgucgucgacgccggggugagcgucauaauggacuuccacuacaacgaaaagcgcauauacugggucgaccucgagcgccaguugcuccagcgcgucuucuuaaacggcagccgccaggaacgcgucugcaacaucgaaaagaacgucagcgggauggccaucaacuggaucaacgaggaggucaucuggagcaaccagcaagaggggauaaucaccgucaccgacaugaaggggaacaacagucauaucuugcucucggcccucaaguacccggccaacgucgccgucgacccggucgagcgcuucaucuucuggagcagcgaagucgccgggucguuguaccgcgccgacuuggacggggucggggucaaagccuuacucgaaaccagcgaaaagaucaccgccgucagccucgacgucuuggacaaaagauuauucuggauccaauauaaucgcgaggggucgaacagcuugaucuguaguugcgacuacgacggggggagcgugcauaucucgaagcacccgacccaacacaaccucuucgccaugaguuuguucggggauaggauauuuuacagcaccuggaagaugaaaaccaucuggaucgcgaauaagcauaccgggaaagauaugguccgcaucaauuugcacagcagcuucgucccguugggggaguuaaaggucguccacccguuggcccagccgaaagccgaggacgauaccugggaaccggaacaaaaguuguguaagcuccgcaaggggaauuguucgucgaccgucugcggccaggauuugcaaagccaucucuguaugugcgccgaaggguaugcguugucgagggauagaaaauauugcgaggacgucaacgagugcgccuucuggaaccacgggugcaccuugggcugcaagaauacgccggggaguuacuauuguaccuguccggucggguucgucuuauugccggacggcaagaggugccaccaguuggucaguugcccgaggaacgucagcgaguguucgcacgauugcgucuuaaccagcgaggggccgcucugcuuuugcccggaggggagcgucuuggaacgcgacggcaagaccugcucggggugcaguagcccggacaacggggggugcucgcaauugugugucccguugucgccggucaguugggagugcgacuguuucccgggcuacgauuugcaguuagacgagaagucgugcgccgccagcgggccgcagccguuccucuuauucgcgaacagccaggacaucaggcauaugcacuucgacgggaccgauuacgggaccuuauugucgcaacaaauggggauggucuacgcguuggaccacgauccggucgagaacaaaaucuauuucgcgcacaccgcguuaaaauggaucgaacgcgccaacauggacgggagucaaagggagcgcuugaucgaagagggggucgacgucccggagggguuggccgucgauuggaucgggaggcgcuuuuacuggaccgaucgcggcaagagcuuaaucgggcgcucggaccucaacggcaagaggaguaagaucauaaccaaagaaaauauaagccagccgagggggaucgccguccacccgauggcgaaacgccucuuuuggaccgacaccggcaucaacccgaggaucgagucgagcaguuugcagggguuggggagguuagucaucgcgucgagcgacuugauauggccgucggggaucaccaucgauuuucucaccgauaaacucuauuggugugacgcgaaacaaagcgucaucgagauggcgaacuuagacgggagcaagaggaggcgcuugacgcaaaacgacgucgggcauccguucgccgucgccgucuucgaagacuacgucugguuuagcgacugggccaugccgagcgucaugcgcgucaauaaacgcaccgggaaggaccgcgucagguugcaggggucgauguuaaaaccgagcagcuuagucgucguccacccgcucgccaagccgggggccgacccgugucucuaccagaauggggggugcgagcacaucuguaagaaacgcuuggggaccgccuggugcagcugcagggagggguucaugaaggcgagcgacggcaagaccugcuuagccuuagacgggcaccaauuacucgccgggggggaggucgacuugaaaaaucaggucaccccgcucgauauacucaguaaaacccgcgucagcgaggacaauaucaccgagagccagcauauguuggucgccgagauaauggucagcgaccaggacgauugcgccccggucggguguucgauguacgccagaugcaucagcgaaggggaagacgcgaccugccaaugccucaagggguucgccggcgacgggaaguugugcagcgacaucgacgagugcgaaaugggggugccggucuguccgccggcgaguaguaaauguauaaauacggaggggggguacguguguagauguagcgagggguaucagggggacggcauccauugcuuggacaucgacgaaugucaguuaggcgaacauucgugcggggaaaacgcgucguguaccaacaccgaagggggguacacguguaugugcgccgggagguuaagcgagccgggguuaaucuguccggauagcaccccgccgccgcauuugcgcgaggacgaucaucauuacaguguccgcaacucggauagcgagugcccguuaagucaugacggcuauuguuugcacgacggggucuguauguacaucgaggcccucgauaaauacgccuguaauugcgucgucggguauauaggcgaaaggugccaauauagggauuuaaaauggugggaguuaaggcaugccgggcauggccaacaacaaaaagugauagucgucgccgugugugucgucgucuuggugauguuauuguuguuaucguuauggggcgcgcauuauuaucgcacccaaaaauuauugagcaagaauccgaaaaacccguacgaagaaagcucgcgcgacguccgcucgaggcgcccggccgauaccgaagacggcaugaguagcuguccgcagccgugguucgucgucaucaaggagcaucaggauuugaaaaacggcgggcagccggucgccggggaagacgggcaagccgccgacggcagcaugcagccgaccagcuggcgccaagaaccgcaacucugcgggauggggaccgaacagggguguuggaucccggucaguucggacaaagggaguugcccgcaagucauggaaaggucguuccacaugccgaguuacggcacccaaacguuggagggcgggguggaaaaaccgcacagcuuguugagcgccaauccgcucuggcagcagcgcgcguuagauccgccgcaucagauggaauuaacccaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5692 - RNA, 892 nt, Artificial Sequence
  mRNA product Design2 comprising derived and/or modified sequence from Homo sapiens__NP_001423.1__HsEREG (opt10)
ggggcgcugccuacggagguggcagccaucuccuucucggcaucaagcuuaccaugacggccggccgccgcauggaaauguugugcgcggggcgcgugccggccuuauuauuguguuuaggguuucacuuguugcaagccguguugucgaccaccgucaucccgagcugcauaccgggggaaaguucggacaauuguaccgcccucguccaaaccgaggauaacccgagggucgcccaggucagcaucaccaaaugcucgagcgauaugaacggguacugccuccacgggcaauguauauacuuagucgauaugucgcagaauuauugucgcugcgaggucggguacaccggggugaggugcgagcauuuuuuccucacggugcaucagccgcucucgaaggaguacgucgcccucacggucaucuugaucauccucuucuugauaaccgugguggggaguaccuacuacuuuugucgcugguaucgcaacaggaagucgaaggagccgaaaaaagaguacgaacgcgucacgagcggcgacccggaacucccccaggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5693 - RNA, 850 nt, Artificial Sequence
  mRNA product Design2 comprising derived and/or modified sequence from Homo sapiens__NP_000791.1__HsFGF1 (opt10)
ggggcgcugccuacggagguggcagccaucuccuucucggcaucaagcuuaccauggcggagggugagauaacgacguucacugcguuaacggagaaguucaacuuaccgccggguaacuacaagaagcccaaguuguuauacugcucgaacggggggcacuucuuacgaauauuaccagacggcacgguagacgguacccgagaccggucggaccagcacauccaguuacaauuaucggcggagaguguuggcgagguauacaucaagucgacugagacagggcaguacuuggcgauggacacggacggguuauuguacgggagucaaacgccgaacgaggagugcuuauucuuagagcgcuuggaggagaaccacuacaacacguacaucucgaagaagcacgcggagaagaacugguucguaggguuaaagaagaacgguaguugcaagcgggggccacgcacgcacuacggucagaaggcgaucuuauucuugccguuaccaguaucgagugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5694 - RNA, 1249 nt, Artificial Sequence
  mRNA product Design2 comprising derived and/or modified sequence from Homo sapiens__NP_001997.5__HsFGF2 (opt10)
ggggcgcugccuacggagguggcagccaucuccuucucggcaucaagcuuaccauggugggcgucgggggcggggacguggaggacgugaccccgcgcccgggcgggugccagaucucgggccggggcgcccgcgggugcaacggcauccccggggccgcggccugggaggccgcccugccccggcgccggccccgccggcacccguccgucaacccccgcucgcgggccgcgggcucgccccgcacccgggggcgccggacggaggagcgccccuccggcucccggcucggcgaccgcgggcggggccgcgcccugcccgggggccggcugggcgggcgcggccgggggcgcgcccccgagcgcgugggcgggcggggccgcggccgggggaccgccgcgccccgcgccgcccccgccgcccggggcucgcgcccggggcccgcgggcaccauggccgccggguccaucaccacgcuccccgcccugcccgaggacggcggcucgggggccuucccgcccggccacuucaaggaccccaagcggcuguacugcaagaacgggggcuucuuccuccgcauccaccccgacgggcggguggacggcguccgcgagaaguccgacccgcacaucaagcugcagcugcaggcggaggagcggggcguggugucgaucaagggggucugcgccaaccgcuaccucgccaugaaggaggacggccggcugcuggccuccaagugcgugaccgacgagugcuucuucuucgagcgccucgagucgaacaacuacaacaccuaccggucccgcaaguacaccucgugguacguggccuuaaagcggacggggcaguacaaguuaggcuccaagaccggccccgggcagaaggcgauccucuucuuacccaugucggccaaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5695 - RNA, 967 nt, Artificial Sequence
  mRNA product Design2 comprising derived and/or modified sequence from Homo sapiens__NP_002000.1__HsFGF7 (opt10)
ggggcgcugccuacggagguggcagccaucuccuucucggcaucaagcuuaccaugcacaaguggauauuaacguggauauugccgacguuauuauacaggucgugcuuccacauaauaugcuuggucgggacaauaaguuuagcgugcaacgacaugacgcccgagcaaauggcgacgaacguaaauugcucgaguccggagagacacacgaggucguaugacuauauggaggggggcgacauaagagucaggagauuauucugcaggacacaaugguauuugagaauagacaagaggggcaaagucaaggggacgcaagagaugaaaaacaacuauaacauaauggagauaagaacgguagccgucggcauagucgcgauaaaagggguagagagugaguucuauuuagcgaugaacaaggaggggaaguuauaugcgaagaaggagugcaacgaggacugcaauuucaaggaguugauauuagagaaccacuauaacacguacgcgucggccaaguggacacacaacggcggggagauguucgucgcguuaaaccaaaagggcauaccggucagggggaagaagacgaagaaagagcaaaagacggcgcacuucuugccgauggcgauaacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5696 - RNA, 1009 nt, Artificial Sequence
  mRNA product Design2 comprising derived and/or modified sequence from Homo sapiens__NP_001936.1__HsHBEGF (opt10)
ggggcgcugccuacggagguggcagccaucuccuucucggcaucaagcuuaccaugaaguuguuacccucaguuguacucaaauuauucuuagcggccguauuaagugcucuugugaccggcgagucguuggagcguuugcgccgcggucuugcagcgggcacgaguaacccggacccgccgacggucucgaccgaccaguuacucccucucgggggcgggcgcgaccguaagguucgggaccuccaggaggcggacuuagaccuccuacguguuacgcuuucgucgaagccccaggccuuggcgaccccuaacaaggaggagcacgguaagcguaagaagaaggggaaggggcuuggcaagaagcgugacccgugcuugcgaaaguacaaggacuucugcauacacggggagugcaaguacgucaaggaguuacgagcgccgaguugcaucugccacccgggcuaccacggggagcgaugccacggcuugucguuaccgguagagaaccguuuguacacuuacgaccacacuaccauacucgccguagucgcgguugucuuaucgucgguaugcuuauuaguaauaguaggcuuauuaauguuccgauaccaccgacgcgggggcuacgacguagagaacgaggagaaggugaagcuagggaugacgaacucgcacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5697 - RNA, 2569 nt, Artificial Sequence; identical to SEQ ID NO: 5680
  mRNA product Design2 comprising derived and/or modified sequence from Homo sapiens__NP_000592.3__HsHGF (opt10)

SEQ ID NO: 5698 - RNA, 2308 nt, Artificial Sequence
  mRNA product Design2 comprising derived and/or modified sequence from Homo sapiens__NP_005336.3 __HsHSPA1A (opt10)
ggggcgcugccuacggagguggcagccaucuccuucucggcaucaagcuuaccauggcgaaggcggcggcaauagggauagacuuagguacgacguacucgugcguugguguauuccagcacgguaagguagagauaauagcgaacgaccaggguaaccggacgacgccgaguuacgucgcguucaccgacacggagcgcuugaucggggacgccgcgaagaaccagguagcuuuaaacccacaaaacacgguuuucgacgcaaagcgacucauagggcgaaaguucggggaccccgucguacaaucagacaugaagcacuggccguuccaggucauaaacgacggugacaagccgaagguccagguaaguuacaagggcgagacgaaggcguucuacccugaggagaucucaaguaugguauugacgaagaugaaggagauagcggaggcauacuuaggauaccccgugacgaacgccguaaucacgguccccgcguacuucaacgacucucagcggcaggcgacgaaggacgcaggcguaaucgcaggguuaaacguauugcgcaucauaaacgagccgaccgcggcggcgauagcauacggguuagaccggaccgggaagggugagcgaaacguauuaaucuucgacuuggguggggguacguucgacgucucgauauuaaccaucgacgacggcauauucgagguaaaggcgaccgccggggacacgcacuuaggcggggaggacuucgacaaccgauuggucaaccacuucguagaggaguucaagcgaaagcacaagaaggacauaucgcagaacaagcgugcgguaagaagguuacgaacggcgugcgagcgggcuaagcgcacguuaaguucgaguacgcaggcgucguuggagauagacaguuuauucgaggguauagacuucuacacuucgauaacgcgugcacgauucgaggaguuaugcucggacuuauucaggucgacguuagagccgguagagaaggcauuacgagacgcgaaguuggacaaggcacagauacacgacuuaguauuaguaggugguucgacgcggauaccgaagguacagaaguuguuacaggacuucuucaacggucgagacuuaaacaagucgaucaacccggacgaggcgguagcguacggggccgcgguacaggccgcgauauugaugggugacaagagugagaacguacaggacuuauuauuauuagacguagcacccuuaucuuuggguuuagagaccgcggguggggucaugacggcguuaauaaagcgaaacucgacgaucccgacgaagcagacccagaucuucacuacguacucggacaaccagccggguguauugauccagguauacgagggugagcgagcgaugaccaaggacaacaacuuauuaggacguuucgaguugucggguauaccgcccgcaccucgaggggucccgcagaucgaggucacguucgacaucgacgcgaacgguaucuuaaacguaacggcgaccgacaaaaguacggggaaggccaacaagaucacgauaacgaacgacaagggucgauuaucgaaggaggagauagagaggaugguccaggaggcagagaaguacaaggccgaggacgagguccagagagagcgaguaagugcgaagaacgcguuggagucguacgcguucaacaugaagagugcggucgaggacgaggguuuaaaggguaagaucucggaggccgacaagaagaaggucuuagacaagugccaggagguuauaucuugguuagacgcgaacacguuagcggagaaggacgaguucgagcacaagcgcaaggaguuagagcagguaugcaacccgauaauaucggguuuguaccagggggcgggcgggccggguccgggugguuucggcgcgcagggaccgaagggugguagugggucggguccgacgaucgaggagguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5699 - RNA, 2308 nt, Artificial Sequence; identical to SEQ ID NO: 5698
  mRNA product Design2 comprising derived and/or modified sequence from Homo sapiens__NP_005337.2 __HsHSPA1B (opt10)

SEQ ID NO: 5700 - RNA, 2308 nt, Artificial Sequence
  mRNA product Design2 comprising derived and/or modified sequence from Homo sapiens__NP_005518.3 __HsHSPA1L (opt10)
ggggcgcugccuacggagguggcagccaucuccuucucggcaucaagcuuaccauggcgacggcgaaggguauagcuauagguauagacuuaggaacgacauacucgugcguaggugucuuccagcacgggaaggucgagaucauagcuaacgaccaggggaacaggacaacgccgaguuacgucgcguucaccgacacugagagauugaucggugacgcggcgaagaaccaggucgcgaugaacccucaaaacacgguauucgacgcgaagcgguuaaucggucgcaaguucaacgacccggucguucaggcggacaugaaguuauggccguuccaaguaauaaacgagggcggaaagccgaagguauugguaucguacaagggugagaacaaggcauucuacccggaagagauaaguucgaugguuuuaaccaaguuaaaggagacagcggaggcguucuuaggucauccgguaacuaacgcgguaaucacgguacccgcuuacuucaacgacagucagcggcaggcgacgaaggacgcgggggucauagcggguuuaaacguauuacgcauaauaaacgagccaacggcagcggcgauagcguacggucuugacaaggggggacagggugagcggcacguauuaaucuucgacuuagguggcgguacauucgacgucucgauauugacgaucgacgacgguauauucgagguaaaggcgacggcgggugacacgcacuuagguggugaggacuucgacaacagauuaguaagucacuucgucgaggaguucaagcggaagcacaagaaggacauaucgcaaaacaagcgcgcuguaaggagauugcggacggccugcgagcgcgcgaagcggacguuaaguucgucgacgcaggcgaaccucgagauagacucguuguacgaggguauagacuuuuacacgaguaucacgcgagcgagauucgaggaguuaugcgccgacuuauuccgcgggacauuggagcccguugagaaggcguuaagggacgcgaagauggacaaggcgaagauccacgacauaguauuagucggugguucgacccgaauaccgaagguacagcgguuauuacaagacuacuucaacggucgcgacuugaacaagucgauaaacccggacgaggcgguagcguacggggcggcaguccaggcggcgauauuaaugggggacaagucggagaagguccaagacuuauuauuguuggacguugcgccguuaaguuuagguuuagagacugcgggcgguguaaugacggcguuaaucaagcggaacucgacaauaccaacgaagcagacgcaaauauucacuacguacagugacaaccagccggguguauugauacagguauacgagggugagcgggcgaugacgaaggacaacaacuuauuaggucguuucgacuuaacugguauaccuccggcuccgcgggggguaccgcaaauagaggucacguucgacauagacgcgaacgggaucuuaaacguaacggcgaccgacaagucgacagguaagguuaacaagauaacuauaacgaacgacaaggguagauuaucgaaggaggagaucgagaggauggucuuggacgcggagaaguacaaggcagaggacgagguacagagagaaaagauagcggcgaagaacgcguuagagaguuacgcguucaacaugaagucgguaguaucggacgagggauuaaaggguaagaucucggagagugacaagaacaagauauuagacaagugcaacgaguuauuaucgugguuggagguuaaccaguuagcggagaaggacgaguucgaccauaagaggaaggaguuagagcaaaugugcaacccgaucaucacgaaguuauaccagggggguugcacggguccggcgugcgguacggguuacgucccugggcgaccggcaacagguccgacgauagaggagguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5701 - RNA, 2302 nt, Artificial Sequence
  mRNA product Design2 comprising derived and/or modified sequence from Homo sapiens__NP_068814.2 __HsHSPA2 (opt10)
ggggcgcugccuacggagguggcagccaucuccuucucggcaucaagcuuaccaugucggccagggggccggccauagggaucgauuuggggacgacguauagcugugucggggucuuucaacaugggaagguggagaucauagccaaugaucagggcaaucgcacgaccccgaguuacgucgcguucaccgauacggagagguugauaggggaugccgcgaaaaaucaagucgccaugaauccgaccaauaccauauuugaugccaaacgcuugauagggaggaaauuugaggaugccaccgugcagucggauaugaaacauuggccguuuagggucgucagugagggggggaagccgaaaguacagguggaguauaagggggaaaccaaaacguucuuuccggaggaaauaagcucgauggucuugacgaagaugaaggagaucgccgaagccuacuugggggggaaagugcauucggccgucaucaccgugccggccuauuucaaugauucgcagcgccaggccaccaaggaugccgggacgaucaccggguugaauguguugaggaucauaaacgagccgaccgccgccgccauagccuauggguuggauaaaaaggggugugcggggggggaaaagaauguguugaucuuugauuuggggggcgggaccuuugaugugagcaucuugacgaucgaggaugggauauuugaagugaagucgaccgcgggggauacccauuuggggggcgaggauuuugauaauaggauggucucgcacuuggcggaggaauuuaagcgcaaacauaaaaaggacaucgggccgaauaagagagccguccgccgcuugcgcacggccugugagagagccaagcgcacguugucgagcucgacccaggccucgaucgagauagauaguuuguaugagggcgucgauuuuuauacgagcauaaccagagcgagguucgaagaguugaaugcggacuuauuuagggggaccuuggagccgguggagaaggccuugagggaugccaagcucgauaaggggcagauccaggagaucguguuagugggggggaguacgaggauaccgaagauacagaaguuguugcaggauuuuuuuaauggcaaggaguugaauaagagcaucaauccggacgaggccguggcguauggggccgccguccaggccgccaucuugauaggcgauaagucggaaaaugugcaggauuuguuguuauuggaugucacgccguugagcuugggcaucgaaaccgccgggggggucaugacgccguuaaucaagaggaauaccacgaucccgaccaagcaaacgcaaacguuuaccacguauucggauaaucaaagcagugucuuggugcaagucuaugaaggggagagggccaugaccaaggauaauaauuugcucgggaaauuugauuugaccgggauccccccggccccgaggggggucccgcagauagaggugaccuucgauaucgaugcgaaugggauauugaaugucacggccgcggauaagucgaccggcaaagagaauaaaauaaccaucaccaaugauaagggccgcuuaucgaaggaugauaucgauaggauggugcaggaggccgagagguauaagagcgaggacgaagccaaucgcgauaggguggccgccaaaaaugccuuagagagcuauacguauaauauaaaacaaacgguggaggaugagaaguuaagggggaagaucucggagcaggauaagaauaagaucuuagauaagugccaggaggugaucaauugguuggauaggaaucagauggcggagaaggaugaguaugagcauaagcagaaggaguuggagagggucuguaauccgaucauaagcaagcucuaucagggggggccgggggggggcucgggggggggggggaguggggccucgggggggccgacgauagaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5702 - RNA, 2905 nt, Artificial Sequence
  mRNA product Design2 comprising derived and/or modified sequence from Homo sapiens__NP_002145.3 __HsHSPA4 (opt10)
ggggcgcugccuacggagguggcagccaucuccuucucggcaucaagcuuaccaugucagucguagguaucgaccucgguuuucaaaguuguuacguagcgguagcgcgagcuggagguauagagacgauagcaaacgaauacucggaccgaugcacuccugcgugcauaucguucgggccgaagaacaggucgauaggggccgcggcaaagucgcagguuaucucaaacgcgaaaaacacgguacaggguuucaagcgauuucacggucgugcguucucggacccuuucgucgaggccgagaagaguaacuuagcguacgacauaguucaauuaccgacgggucucacgggcauuaagguaacuuacauggaagaggagcgcaacuucacuacggagcagguaacggcgauguuguuaucgaaguuaaaggaaacggcagagucgguauuaaagaagccagugguagacugcguaguaucaguaccgugcuucuacacggacgcggagcggcguucgguuauggacgccacgcagauagcggggcucaacuguuuacgccuaaugaacgagacgacggccguagcguuagcguacgggauuuacaagcaggacuugccagcgcuugaggagaagccgcgcaacguuguauucguggacaugggacacucggcauaccaggugucggucugcgcguucaaccgggggaagcucaaggucuuagcgacggcguucgacaccacguuaggcggacgcaaguucgacgagguacucguuaaccacuucugcgaggaguucgguaagaaguauaaguuagacauaaagucgaagauucgagcguugcuucguuuaucgcaggagugcgagaaguuaaagaaguuaaugucagcgaacgcgucggacuugccccuuucgaucgagugcuucaugaacgacguagacguuucagggaccaugaacagggggaaguucuuagagauguguaacgacuuauuggcacgagucgaaccucccuugaggucggucuuagagcagacaaaguugaagaaggaggacauauacgcgguagagaucgucggaggggcaacgcguauuccggcaguuaaggagaagauaucgaaguucuucggcaaggaguuaucgacgacgcuuaacgcggacgaggcgguaacgagggguugcgcguuacagugcgcuauacuuucuccagcguucaagguacgcgaguucucgauaacggacguuguuccguaccccaucaguuuacgguggaacucgccggcggaggaggguucgucggacugcgagguguucucgaagaaccacgcggcgcccuucucgaaggucuuaacguucuaccgaaaagagccguucacauuagaggcauacuacaguucgccacaggaccuuccuuacccggacccggcgaucgcacaguucucgguacaaaagguuacgccccagucggacgguucgucgucgaaggucaagguaaaggugaggguuaacguucacgguaucuuuucggucaguucggcgucgcuuguagagguccacaagucggaggagaacgaggagccgauggagacggaccagaacgcgaaagaggaggagaaaaugcagguagaccaggaggagccgcacguagaggagcagcaacagcagacgccggcggagaacaaggcggagucggaggagauggagacuucgcaggcgggcucgaaggacaagaaaauggaccagccuccgcaggcgaaaaaggcgaaggucaagacaucuaccgucgacuuaccgauagagaaccaguuauuguggcaaaucgaccgagagauguuaaacuuauacaucgagaacgaggggaaaaugaucaugcaggacaaguuggaaaaggagcgcaacgacgcgaaaaacgcgguugaggaguacguuuacgagaugcgugacaaguuaucgggcgaguacgagaaguucgucucggaggacgaccgaaacucauucacguuaaaguuggaggacacggagaacugguuauacgaggacggggaggaccaaccgaagcagguauacgucgacaagcuagcggagcuuaagaacuugggacagcccauaaagaucagguuccaagagagugaggagcgcccgaagcuauucgaggaguuagguaagcaaauacagcaguacaugaagaucauaucuaguuuuaagaacaaggaggaccaauacgaccacuuagacgcggcagacaugacuaaggucgagaagaguacgaacgaggcgauggaguggaugaacaauaaguuaaacuuacaaaacaagcagucguuaacgauggacccgguaguaaagucgaaggagaucgaggccaagaucaaggaguuaaccucuacaugcucgccaaucauaucgaagccgaagccgaagguagagccgccgaaggaggagcagaagaacgccgagcaaaacggccccguagacggucagggugacaaccccgggccucaggcggcagaacaggggacggacaccgcgguaccgucugacucggacaaaaaguuaccggagauggacaucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5703 - RNA, 2902 nt, Artificial Sequence
  mRNA product Design2 comprising derived and/or modified sequence from Homo sapiens__NP_055093.2 __HsHSPA4L (opt10)
ggggcgcugccuacggagguggcagccaucuccuucucggcaucaagcuuaccaugagcgucgucgggaucgauuugggguucuugaauuguuauauagccguggcccgcucgggggggauagaaacgauagcgaacgaauauucggaucgcuguacgcccgcgugcaucagccucgggagccgcaccagggcgauagggaacgccgccaaaucgcaaaucgugaccaauguccgcaacaccauccacggguuuaagaaauugcacggcaggagcuucgacgauccgaucguccagaccgagcgcauacgcuugccguacgaauuacaaaagaugccgaacgggucggccggggucaaagucagauaucucgaagaggaacgcccguucgccaucgaacaagucaccgggauguuacucgcgaaauugaaggaaaccagcgagaacgcccucaaaaagccggucgccgauugcgucaucagcaucccgucguuuuucaccgacgcggaacgccgcagcgucauggccgccgcgcaagucgccgggcucaacugccuccgccucaugaacgagaccaccgccgucgccuuagccuacgggaucuacaagcaagacuugccgccgcucgacgaaaagccgcgcaacgucgucuucaucgacauggggcauagcgcguaccaagugcucgucugcgccuuuaauaaagggaaguugaaggugcucgccaccacguucgacccguaccucggggggcgcaauuucgacgaagcccucgucgauuauuuuugcgacgaauuuaaaacgaaguacaaaaucaacgucaaggagaauagcagagcgcuccucaggcucuaccaagaaugcgagaaguugaaaaaauugaugucggccaacgccagcgacuugccgcucaauaucgaaugcuuuaugaacgauuuggacgucagcucgaagaugaaucgcgcccaguucgaacaauuaugcgccaguuugcucgcgcgcgucgagccgccgcucaaagccgucauggagcaagccaaucuccaaagggaggauaucucgucgaucgagaucgucgggggggccaccaggaucccggccgucaaggagcaaauaaccaaguuuuucuugaaggauaucucgacgacccucaacgccgacgaggccgucgcccgcgggugcgcccuccaaugcgccaucuugagcccggccuucaaggucagggaguucaguaucaccgauuuggucccguacagcauaacccuccgcuggaaaacgagcuucgaggacgggucgggcgagugcgaggucuuuugcaaaaaucauccggcgccguuuagcaaagugaucaccuuucauaaaaaagagccguucgaguuggaggccuucuacaccaaccuccaugaggucccguauccggacgcccgcaucggcucguuuaccauccaaaacgucuucccgcaaagcgacggggacucgaguaaggucaaagucaaggucagggucaauauacacgggauauuuucggucgccucggccagcgucaucgaaaaacagaaccucgagggggaccauucggacgccccgauggaaaccgagaccagcuucaagaacgagaauaaggacaacauggacaagaugcaagucgaccaagaggagggccaccagaagugccacgccgagcauaccccggaggaagagaucgaccauaccggggcgaagaccaaaagcgccgugagcgauaagcaagauaggcucaaccaaaccuugaagaaggggaaaguaaagucgaucgacuugcccauacaaucgucguugugccgccaauuggggcaagacuuguuaaauucguauaucgagaacgaaggcaaaaugauaaugcaagacaaacucgaaaaggagcgcaacgacgccaaaaacgcggucgaggaguacgucuacgacuuccgcgaucgcuuagggaccguguacgagaaguuuauaaccccggaagaucucucgaaauuaagcgccguccucgaggauaccgaaaacugguuguacgaggauggggaagaucaaccgaagcaggucuacgucgacaaauugcaggaguugaaaaaguaugggcaaccgauccaaaugaaauauauggaacacgaagaacgcccgaaggcgcucaacgaucucgggaaaaaaauacaauuggugaugaaagucaucgaagccuaccgcaauaaagacgagcgcuacgaccacuuagacccgaccgaaauggagaaagucgagaagugcauaucggacgcgaugucgugguuaaacucgaaaaugaacgcccaaaauaaguugucguugacccaggacccggucgucaaggucagcgagaucgucgccaaaagcaaagaguuagacaacuuuugcaauccgauaaucuauaaaccgaaaccgaaggccgaggucccggaggauaagccgaaggccaacucggaacauaacgggccgauggacgggcaaucggggaccgagaccaagagcgacagcaccaaggauucgagccaacacaccaaaaguagcggggaaauggaggucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5704 - RNA, 2347 nt, Artificial Sequence
  mRNA product Design2 comprising derived and/or modified sequence from Homo sapiens__NP_005338.1__HsHSPA5 (opt10)
ggggcgcugccuacggagguggcagccaucuccuucucggcaucaagcuuaccaugaaauugaguuuagucgcggccauguuauuauuauugucggccgccagagcggaagaagaagauaaaaaagaagaugucgggaccgucguggggauagauuuaggcacgacguauaguugugugggggucuuuaaaaaugggagggucgaaauaauagcgaaugaccaagggaauaggauaacccccaguuacguggcguuuaccccggagggcgagagguuaaucggggacgcggcgaaaaaucaauugacgaguaauccggaaaauaccguguucgaugcgaaaagauugauagggaggaccuggaacgaucccagcguccaacaagauauaaaauuucuccccuuuaaagucgucgagaaaaagaccaagccguauauccaggucgacaucggggggggccagaccaaaaccuucgccccggaggagaucagcgcgauggucuugaccaagaugaaggagacggccgaagccuaccucgggaaaaaagucacgcacgccgucgucaccgucccggcguacuucaacgacgcgcagaggcaggccacgaaggaugccgggaccaucgccggguugaacgucaugcgcauaauaaaugaaccgaccgccgccgccaucgccuacggguuagacaaacgcgaaggcgaaaaaaauauauuagucuucgauuuagggggggggacguuugacgucagcuuguugacgaucgauaacgggguguuugaggucgucgcgaccaacggggacacccacuuagggggggaggauuucgaucaaagggugauggagcauuuuauaaaguuauauaagaaaaaaaccgggaaggacgugcgcaaggauaaccgcgccguccaaaaguugagaagggaagucgagaaagcgaagagagcguuaagcagccaacaccaggcccgcaucgagaucgaaaguuuuuacgagggggaggauuucagcgaaacguuaaccagagcgaaguucgaggaauugaauauggacuuauuuagaagcaccaugaaaccggugcaaaagguccucgaggacagcgaccucaaaaaaagcgacaucgacgagaucgucuuggucggggggagcaccaggaucccgaaaauccaacaguuagucaaggaauuuuuuaacgggaaagagccgaguagggggaucaauccggacgaggccgucgccuacggggccgccgugcaagccggggucuugagcggggaccaggacaccggggauuuagucuuauuggacgucugcccguugaccuuggggaucgagaccgucgggggggugaugacgaaguuaaucccgcgcaauaccgucgucccgacgaaaaaaagccaaauauucagcaccgccagcgacaaccagccgaccgucaccauaaaaguguacgagggggagcgcccguuaaccaaggauaaccacuuguuagggaccuucgacuuaaccgggaucccgccggccccgaggggcgugccgcaaaucgaggugacguucgaaaucgacgucaacgggaucuugagggucaccgccgaggauaaagggaccggcaauaagaacaaaauaaccauaacgaacgaucaaaacagguuaaccccggaggagauagagcgcauggucaacgacgccgaaaaauucgccgaagaggauaagaaauugaaagaaaggaucgacacccgcaacgaacucgagucguacgcguacagcuugaaaaaccaaaucggggacaaggagaaauuaggggggaaguugaguagcgaggacaaagaaacgauggagaaggccgucgaggagaaaaucgagugguuagagucgcaucaggacgccgauaucgaggauuuuaaggccaaaaaaaaagaguuagaggagaucguccagccgaucauaucgaaguuguacgggucggccgggccgccgccgaccggggaggaagacaccgccgagaaggacgaacucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5705 - RNA, 2314 nt, Artificial Sequence
  mRNA product Design2 comprising derived and/or modified sequence from Homo sapiens__NP_002146.2__HsHSPA6 (opt10)
ggggcgcugccuacggagguggcagccaucuccuucucggcaucaagcuuaccaugcaagcgccgagagaauuggccgucgggauagauuuagggacgacguauagcugugucggggucuuccaacaagggagggucgaaauauuagcgaaugaucaagggaauaggacgaccccgucguaugucgcguuuacggauacggaaagauuagugggcgaugccgcgaaaucgcaagccgcguuaaauccgcauaauacggucuuugacgcgaaaagauuaauaggcaggaaauuugccgauacgaccguccaaagcgauaugaaacauuggccguuuagagucgucucggaaggggggaaaccgaaagucagggucuguuauaggggcgaagauaaaaccuuuuauccggaagaaauaagcaguauggucuuaucgaaaaugaaagaaaccgcggaagccuauuuagggcaaccggucaaacaugccgucauaacggucccggcguacuuuaacgauagccaaaggcaagcgacgaaagaugccggcgcgauagccggcuugaauguccucagaauaauaaacgaaccgaccgccgccgcgauagcguacggcuuagauagaagaggggccggggaaaggaaugucuugaucuucgauuuagggggcgggacguuugacgucagcgucuugaguaucgaugccgggguguucgaagucaaggcgaccgccggggacacgcauuuagggggggaagauuuugauaauagauuggucaaucauuuuauggaggaguuuagaagaaaacacggcaaagauuuaucgggcaauaaaagggcguuaaggcgcuuaaggaccgcgugcgaaagggcgaaaaggacguuaaguaguucgacgcaagcgacguuagaaaucgauaguuuauuugaaggggucgauuuuuauaccaguauaaccagggcgagguucgaagaguuauguagcgauuuguuuaggucgacguuagaacccgucgaaaaagcguuaagagacgcgaaauuagauaaagcgcaaauccacgaugugguguuagucggcgggaguaccaggauaccgaaaguccaaaaacucuuacaagauuuuuuuaaugggaaagaauuaaauaaaucgauaaauccggacgaagccgucgcguacggcgccgccguccaagccgcgguccucaugggcgauaagugcgaaaagguccaagacuuguuauuauuagacgucgccccgcucagcuuaggcuuagaaaccgccgggggcgucaugacgaccuuaauacaacgcaaugcgaccauaccgacgaaacaaacgcaaaccuuuacgacguauagcgauaaucaaccgggcguguuuauacaagucuacgaaggggaacgcgcgaugacgaaagauaauaauuuauuaggcagguucgaguugucggggauaccgccggcgccgaggggggugccgcaaaucgaagucaccuucgauaucgacgccaacgggauauuaucggucaccgcgaccgaucgcucgaccgggaaagccaauaaaauaacgauaacgaacgauaaagggagauuaucgaaagaagaagucgaacgcaugguccacgaggcggaacaauauaaagccgaagacgaagcgcaacgcgaucgcgucgccgcgaagaauagcuuagaagcgcacguguuucacgucaaggggagccuccaggaagagucguugcgcgauaaaaucccggaggaagaucgcaggaagaugcaggauaaaugcagagagguguuggcgugguuagaacauaaucaauuagccgaaaaagaagaauacgaacaccaaaaacgcgaauuagaacagauaugcaggccgauauuuagucgcuuguacggcggcccgggggugccgggcgggucgucgugcgggacccaggcgaggcaaggcgauccgucgacggggccgauaaucgaagaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5706 - RNA, 1486 nt, Artificial Sequence
  mRNA product Design2 comprising derived and/or modified sequence from Homo sapiens__P48741__HsHSPA7 (opt10)
ggggcgcugccuacggagguggcagccaucuccuucucggcaucaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagucgcaggccgcgcucaacccccacaacacgguguucgacgccaagcgcuuaaucggccggaaguucgccgacaccaccguccagagcgacaugaagcacuggcccuuccagguggugucggagggcgggaagcccaaggucagggugugcuaccggggcgaggacaagaccuucuacccggaggagaucagcagcaugguguuauccaagaugaaggagacggccgaggcguaccucgggcagcccgucaagcacgccgugaucaccgugcccaccuacuucucgaacagccagaggcaggccaccaaggacgccggcgccaucgcggggcugaaggucuuacccaucaucaacgaggccacggccgccgccaucgcguacggccucgacagacgcggcgccgggaagcggaacgugcugaucuucgacuuaggcgggggcaccuucgacgugagcgucuugaguaucgacgccggcguguucgaggugaaggccaccgccggggacacccacuuaggcggggaggacuucgacaaccgccuggucaaccacuucauggaggaguucagacgcaagcacggcaaggaccucucggggaacaagcgggcguuaaggcgguuaaggacggccugcgagcgggccaagaggaccccgaguagcuccacccaggccacccucgagaucgacagcuuauucgagggcguggacuucuacaagaguaucacgcgggccagguucgaggaguuaugcagcgacuuguucagguccaccuuagagcccguggagaaggcguuaagagacgccaagcucgacaaggcccagauccacgacuucgucuuaggcgggggccugcacagccacccccagggggccgagguggcggccggccuccugcagcgccagggggccgagcaggagcaccagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5707 - RNA, 2323 nt, Artificial Sequence
  mRNA product Design2 comprising derived and/or modified sequence from Homo sapiens__NP_006588.1 __HsHSPA8 (opt10)
ggggcgcugccuacggagguggcagccaucuccuucucggcaucaagcuuaccaugucgaaggggccggcgguagguauagacuuaggcacgacguacucgugcguagggguauuccagcacggcaagguagagaucaucgcgaacgaccaggggaaccgaacaacgccgucguacguagcauucaccgacacggagcgcuuaauaggcgacgcggcgaagaaccagguagcgaugaacccgacuaacacggucuucgacgcgaagcgguuaaucggucgacgguucgacgacgcgguaguacagucggacaugaagcacuggcccuucauggucguuaacgacgcagguagaccgaagguacagguggaguacaagggcgagaccaagucguucuacccggaggaggucucgucgaugguguuaaccaagaugaaggagaucgcggaggcguacuuggguaagacggugacgaacgcagucguuacggucccggcguacuucaacgacagucagcgacaggcgacuaaggacgcggguacgaucgcgggauuaaacgucuuacgaaucaucaacgagccgacggcggccgcgauagcguacgggcuagacaagaagguaggugcggagaggaacguauuaaucuucgacuuggggggcgggacguucgacguaucgauauuaaccaucgaggacgguauuuucgagguaaagaguaccgcaggggacacccacuuagggggggaggacuucgacaaccguaugguaaaccacuucauagcggaguucaagcggaagcacaagaaggacauaucggagaacaagcgcgccguacgacguuuacggacggcgugcgagagagcgaagcgaaccuuaaguucgaguacucaggcaucgauagagauagacucguuauacgaggggaucgacuucuacacgucgaucacgcgagcgcgguucgaggaguugaacgccgacuuguuccgagggacgcuugacccgguggagaaggcguuacgggacgcuaaguuagacaagagucagauacacgacauaguauuaguaggggggucgacgcgaaucccuaagauacagaaguuauugcaggacuucuucaacggcaaggaguuaaacaagaguauaaacccggacgaggcaguagccuacggggcggcgguacaggcggcgauucucucgggugacaagucggagaacgugcaggacuuauuauuauuagacguaacgcccuuaucgcucgggaucgagacggcgggggggguaaugacgguauugaucaagaggaacacgacgauaccgacgaagcaaacgcagacguucacgaccuacucggacaaccagccgggcguauuaauacagguauacgagggcgagcgggccaugacgaaggacaacaaccuuuuagguaaguucgaguuaacggguauuccgccggcgccgagggggguaccgcaaaucgagguaacguucgacauagacgcgaacgggauccuuaacguaagugcgguagacaagucgacggguaaggagaacaagaucacgauaacgaacgacaagggccgcuuaaguaaggaggacaucgagcgcaugguacaggaggcggagaaguacaaggcggaggacgagaagcagcgagacaagguaucgucgaagaacucguuggagaguuacgcguucaacaugaaggcgacgguagaggacgagaaguuacaggguaagaucaacgacgaggacaagcagaagaucuuggacaagugcaacgagauaaucaacugguuagacaagaaccagacggcggagaaggaggaguucgagcaccagcaaaaggaguuagagaagguaugcaacccgaucauaacgaagcuauaccaguccgcgggugggaugccgggggggaugccgggcgguuuccccggagggggugccccgccgagugggggggcgucgucgggcccgacgaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5708 - RNA, 2422 nt, Artificial Sequence
  mRNA product Design2 comprising derived and/or modified sequence from Homo sapiens__NP_004125.3 __HsHSPA9 (opt10)
ggggcgcugccuacggagguggcagccaucuccuucucggcaucaagcuuaccaugaucucggcgucgagggccgccgccgcgagguuggucggggcggccgcgaguagagggccgaccgcggcgaggcaucaagacucguggaacggguugucgcacgaagccuuccgcuuggucagccgcagagacuacgccagcgaggcgauaaaaggggccgucgucgggaucgaucucgggaccacgaauaguugugucgccgucauggaggggaagcaagcgaaagucuuagaaaacgcggagggggcgcgcacgacgccgagcgucgucgcguucaccgccgacggggaaagguuggucgggaugcccgcgaaaaggcaagccgugacgaauccgaauaauaccuucuacgccacgaaaagguugaucgggagaagguacgacgacccggagguccaaaaggauaucaagaacgucccguuuaagaucgugagggcgaguaacggggacgcgugggucgaagcccauggcaagcucuacagccccucgcaaauaggggccuucguccucaugaaaaugaaggaaaccgccgagaacuaucucggccauaccgccaagaacgccgucauaaccgugccggccuacuuuaacgauagccaacgccaagcgaccaaagacgccgggcaaauuagcggguuaaacgucuugagagucaucaacgaaccgaccgccgccgccuuggcguacggguuggauaagagcgaggauaagguaaucgccgucuacgaccucgggggggggaccuucgacaucagcauauuagagauccaaaagggggucuucgaagucaagaguaccaacggcgacacguuucucgggggcgaggauuucgaucaagcgcucuugagacauaucgucaaagaauuuaaacgcgaaaccggcgucgaccucaccaaagauaauauggccuugcaacgcgucagagaggccgccgagaaagccaagugcgaguugaguagcagcguccaaaccgauauaaaccucccguacuugaccauggacagcagcgggccgaaacaccucaacaugaaacucacgagggcccaguucgagggcaucgugaccgacuugauacgccgcaccauagccccgugucaaaaggccaugcaggacgccgagguaucgaaaucggauaucggggaggucauauuggucggggggaugacccgcaugccgaaaguccaacaaaccguccaagauuuguucgggcgcgcgccgucgaaagccgugaacccggacgaagccgucgcgaucggggccgcgauccaaggggggguccucgcgggggacgugaccgacgucuuauuguuggacgugaccccgcucagcuuagggaucgagaccuugggggggguguucacgaaguugaucaaccgcaacacgaccaucccgacgaaaaaaucgcaagucuuuagcaccgcggccgacgggcagacccaggucgagaucaaggucugucaaggggagcgcgaaauggccggggauaauaaguuguuggggcaauucacccucaucgggaucccgccggcgccgaggggggucccgcaaaucgaggucaccuucgauaucgacgcgaacggcaucguccacgucagcgccaaggacaaggggaccgggagggaacaacaaaucgucauacaaagcagcggggggcucucgaaggacgacaucgagaacauggucaaaaacgccgaaaaauacgccgaggaggauagaaggaaaaaagagagggucgaggcggucaauauggccgaggggauaauccaugauaccgaaacgaaaauggaagaguuuaaagaucagcucccggccgacgaauguaauaaauuaaaggaggaaaucaguaagaugcgcgaauuguuagcccgcaaagauucggaaaccggggagaacauccgccaagccgcgaguagcuugcaacaagccagcuuaaaauuauuugagauggccuauaaaaaaauggccagcgaaagggaggggagcgggucgagcgggaccggcgagcaaaaagaggaccagaaagaagagaaacaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5709 - RNA, 2410 nt, Artificial Sequence
  mRNA product Design2 comprising derived and/or modified sequence from Homo sapiens__NP_079291.2__HsHSPA12A (opt10)
ggggcgcugccuacggagguggcagccaucuccuucucggcaucaagcuuaccauggcagacaaggaagcaggggguucggacggcccucgugagacugcaccuacuucggcguacucuucgccggcucgaucguuaggugacacugggaucacgccguuaaguccgucgcacauaguaaacgauacggacaguaacguaucggagcagcagucguucuuaguaguaguagcgguggacuucgguaccacgucgucggguuacgcguacucguucacgaaagagccggagugcauacacgucaugcggaggugggaggggggagacccgggcguaaguaaccagaagacaccuacgacgauauuauuaacgccggagcggaaguuccacucguucgguuacgcggcccgugacuucuaccacgacuuagacccaaacgaggcaaagcaaugguuauacuuggagaaauucaaaaugaaguuacacacuacgggagacuuaacgauggacacugacuugacugccgcgaacgguaaaaagguaaaggcgcucgagaucuucgcguacgcauuacaguacuucaaggagcaggccuuaaaggagcucucugaccaggcugggucagaguucgagaacagugacguaagguggguaauaacuguaccggcgauauggaagcagccagcgaagcaguucaugcgccaggcagcguaccaggcgggguuagcgucgccggagaacagugagcaguuaauaaucgcuuuagaaccggaagcggcgucgauauacugccggaaguuacguuuacaccaaaugauagaguuaucaaguaaggcggcgguuaacggguacucagguucggacacuguuggggcggguuucacgcaggcgaaggagcacauccgacgaaacaggcaaucgcgcacauuccucgucgagaacguuauuggcgagauuuggagugagcuugaggagggagacaaguacguaguaguagacucgggugggggaacuguugauuuaacgguacaccaaauuaggcucccagagggucacuuaaaggagcucuacaaggccacgggugguccguacgguagucucgggguugacuacgaguucgagaaguugcucuacaagaucuucggugaggacuucauagagcaguuuaagaucaagcguccggcggcguggguagaccucaugauagcuuucgaaucgcgaaagcgcgccgcagcgccggaccgaacgaacccuuugaacaucacguuaccguucucguucauagacuacuacaagaaguuccguggacacucgguagagcacgcguuacgaaagaguaacguagacuucguaaaguggucgagucaggguaugcuucgcaugucgcccgacgcgaugaacgcguuauucaagccuacuaucgacucgauaauagaacacuugagggacuuauuccagaagccggagguaucgacgguaaaguucuuauucuuagucgggggguucgcagaggcgccguuguuacagcaggcaguucaggcggcguucggugaccagugccgaauaauaauaccccaggacguaggguuaacgaucuugaagggggcgguuuuauucggguuagacccggccguaauaaagguucgacguucacccuugacuuacggugucggcgucuuaaaccgauacguagaggggaagcacccaccggaaaaguuguuagucaaggacggaacacgauggugcacggacguauucgacaaguucauaucggccgaccaaaguguagcguuaggcgaguuaguaaagcgaucguauacgccugccaagccgucgcaauuaguaauagucaucaacaucuacaguucggagcacgacaacguaaguuuuauaacggacccgggagucaagaagugcggaacauuaagguuagacuugacggguacgucggguaccgcgguuccagcgcgccgagagauacagacgcucaugcaguucggugacacggagauaaaggcgacggcgauagacaucgcuacgucuaagucgguaaaggucgguaucgacuuucucaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5710 - RNA, 2443 nt, Artificial Sequence
  mRNA product Design2 comprising derived and/or modified sequence from Homo sapiens__NP_443202.3 __HsHSPA12B (opt10)
ggggcgcugccuacggagguggcagccaucuccuucucggcaucaagcuuaccauguuagcaguacccgagaugggauuacaagguuuauacauagguucgucgcccgagcguucgccgguuccgucgccuccggggucgccacgcacgcaagagucgugcgggauagcaccuuuaacuccuucccagaguccuaagccggaaguucgugcaccgcagcaggcaucguucagugucguagucgcuauagacuucgguacaacaucgucggguuacgccuucucguucgcuucggacccggaggcaauccauaugaugcguaagugggaggguggugacccuggugucgcgcaccaaaagacgccuacgugcuuauuauuaacgccugagggggcguuccacucguucggauacacggcgcgagacuacuaccacgacuuggaccccgaggaggcucgcgacugguuauacuucgaaaaguucaaaaugaagauacacucggcgacugacuuaacguuaaagacacaacucgaggcgguuaacgggaagacaaugccggcguuagaggucuucgcgcacgcguugagguucuuccgcgagcacgcgcuccaggaguuacgagagcaaucgccgucauugccggagaaagacacgguccguugggucuuaaccgucccggcgaucuggaagcaaccggcgaaacaguucaugcgagaggcggcuuauuuagcgggguuaguaucgcgugagaacgcggagcaauuauuaauagcguuagagccggaggcggcgucaguuuacugucgaaaguugcgauugcaccaguuguuagauuuaucaggaagggcgccgggaggcgggcgauugggcgagaggcgaucgauagacucgucguuccgacaggcgcgcgagcagcuccgucguucgaggcauucgcggacguucuuaguagagucggguguuggugaguuaugggcggaaaugcaggcgggugaccguuacguagucgcugacugcgguggggggacgguagacuuaacaguucaccaguuagagcagccacacgguacguugaaagagcuuuacaaggcgucaggagggccguacggggccguagggguugauuuagcguucgagcaguugcucugccggaucuucggcgaggacuucaucgcaacauucaagcgccagcguccagcggcaugggucgacuuaacaauagcguucgaggcacguaagcggacggcaggaccgcaucgagcgggugcauuaaacauaaguuuaccguucucguucauagacuucuaccggaagcaacgcggucacaacguagagacggcgcucaggcgaaguucggucaacuucguaaaguggaguucgcaggguauguugcgcaugaguugcgaggcgaugaacgaguuauuccagccaacaguuucaggcauuauacagcacauugaggcauuauuggcgcgccccgagguacagggggucaagcucuuauucuuggucggaggauucgcggagucggcaguauuacagcacgcaguacaagcggcuuuaggugcgaggggcuuacgcguaguaguaccccacgacgucgguuugacuauauugaagggcgccguuuuauucggucaggcuccgggagucgucaggguucgacggucuccauuaacuuacggugucgguguauuaaaccguuucguccccgguaggcacccgccggagaaguuauugguacgagacggucgaagguggugcacggacguguucgagcguuucguagcagcggaacagucagucgcguuaggagaggagguaaggcguucguacuguccugcaaggccaggacagcgucgagucuuaauuaacuuguauuguugcgcagcggaggacgcacgauucauaacugacccggguguacggaagugcggugccuuaaguuuggaguuagaaccggcggacugcggucaggacacggcgggugcaccaccgggucgucgagagauccgagcagcgaugcaauucggugauacugagauaaaggugacggcgguagacguuucgacuaacaggucgguccgagcaucgaucgacuucuuaucgaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5711 - RNA, 1798 nt, Artificial Sequence
  mRNA product Design2 comprising derived and/or modified sequence from Homo sapiens__NP_008879.3__HsHSPA13 (opt10)
ggggcgcugccuacggagguggcagccaucuccuucucggcaucaagcuuaccauggcgcgcgaaaugacuauacucgggucugcggucuuaacguuacucuuagcagguuacuuagcgcagcaguaccuuccucuuccgacacccaagguaauaggaauagacuuagguacgacauacugcagugucggaguauucuucccgggaacugguaaggucaagguaauaccggacgagaacggacacaucucuaucccgucgauggucucguucacggauaacgacguuuacgucggguacgagucggucgaguuagcggacucuaacccgcagaacacgaucuacgacgcuaagcgauucaucgguaagauauucacggcggaggaguuagaggcagagauagguagguacccguucaaggucuugaacaagaacgggaugguagaguucucaguaaccucgaacgagacgaucacuguaagucccgaguacgucgguucacguuuacuauuaaaguugaaggagauggcggaggcguacuugggcaugccgguagcgaacgcaguaauaucgguccccgccgaguucgacuuaaagcaacgaaacucgacgaucgaggcggcgaacuuagcggggcuuaagauccuucgagugaucaacgagccgacggcggcggcgauggccuacggguuacacaaggccgacguauuccacgugcuugucaucgacuuaggaggugggacacucgacgucucgcuuuugaacaagcaggguggaauguucuugacgcgugcgaugucggguaacaacaaguugggugggcaggacuucaaccagcgauuauuacaguacuuguacaagcaaauuuaccagacguacgguuucgucccgucacgaaaggaagagauacaucgauuaaggcaggcagucgagaugguaaaguugaacuugacguuacaccagucggcgcaauuaagugucuuguuaacgguugaggagcaggaccguaaggagccgcacucgucggacaccgaguuaccgaaggacaaguugucgucggcugacgaccacaggguaaacucggguuucggcagggguuuaucagacaagaagucgggcgagucgcagguacucuucgagacggagaucagucgaaaguuauucgacacguuaaacgaggacuuauuccaaaagaucuuaguuccgauccagcagguuuuaaaggagggucacuuagagaagacggagauagacgagguugucuuggucggugguucgacgcgaaucccccgaaucaggcagguaauacaggaguucuucgggaaggacccaaacacgucggucgauccggacuuagcgguuguuaccgguguugcgauucaggccgggauagacggggguucguggccguuacagguaucagcgcucgagauaccgaacaagcacuugcagaagacgaacuucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5712 - RNA, 1912 nt, Artificial Sequence
  mRNA product Design2 comprising derived and/or modified sequence from Homo sapiens__NP_057383.2__HsHSPA14 (opt10)
ggggcgcugccuacggagguggcagccaucuccuucucggcaucaagcuuaccauggccgcgauagggguccauuuaggguguacgagcgcgugcgucgcgguguacaaagacgggagagccggggucgucgccaacgacgcgggggauagggucaccccggccgucgucgccuauagcgagaacgaggaaaucgucgggcucgccgccaagcagucgcgcauccgcaacaucagcaauaccgucaugaaggucaaacaaauauuagggcgcucgaguucggauccgcaggcgcaaaaguauauagccgagucgaagugccucgugaucgaaaagaacggcaagcucagguacgagaucgacaccggggaggagaccaaguucgucaauccggaggacgucgcgcgcuuaauuuuuucgaaaaugaaggagaccgcccacagcguccucgggagcgacgccaacgacgucgucaucaccgugcccuucgacuucggggaaaaacagaagaacgccuugggggaggccgcccgcgccgccggguucaacguccucaggcucauccaugaacccagcgccgccuuguuggccuacgggaucgggcaggauaguccgaccgggaagucgaacauccucgucuuuaaauugggggggaccagucucagcuugucggugauggaggucaauucggggaucuacagagucuugagcacgaauaccgacgacaauauagggggggcccauuuuaccgagacgcucgcccaauacuuggccagcgaauuucagcgcaguuuuaagcacgacguccgcgggaacgccagggcgaugaugaagcucaccaauucggccgaggucgccaaacacagccucagcacgcucgggucggcgaauugcuuuuuggauagccucuacgaggggcaggacuucgacuguaacgucagucgcgcccgcuucgaguuguugugcagcccguuguucaacaaaugcaucgaggccauacgcggguugcucgaccagaacggguuuaccgccgacgacauaaauaaagucguguugugcgggggcagcagcaggauaccgaaauugcaacaauuaaucaaggacuuguuuccggccgucgaauuguugaacagcauaccgccggacgaggucauaccgaucggggccgccaucgaggccgggaucuugaucggcaaggagaauuuacucgucgaagauagcuugaugaucgaaugcagcgcgcgcgacauccucgucaaaggggucgaugagagcggggcgucgcgcuuuaccgucuuauucccgagcggcaccccgcucccggccaggcgccagcauacccuccaagcgccggggucgaucagcagcgucuguuuggaguuguacgaaagcgacggcaaaaauagcgcgaaagaagagacgaaauucgcccaagucgucuugcaagaucucgauaagaaggagaacgggcucagggacauccucgccgucuugaccaugaagcgcgacgggagccuccacgucaccuguaccgaccaagaaaccgggaagugcgaggccauaagcaucgaaaucgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5713 - RNA, 2959 nt, Artificial Sequence
  mRNA product Design2 comprising derived and/or modified sequence from Homo sapiens__NP_006635.2 __HsHSPH1 (opt10)
ggggcgcugccuacggagguggcagccaucuccuucucggcaucaagcuuaccauguccgugguaggacucgacgucgggagccaaagcugcuacauagcgguagccagggcaggcgggauagagacgaucgccaacgaguucuccgaucgcugcacacccagcgucaucagcuuugguucuaaaaacaggacuauaggaguggccgcgaaaaaccaacaaauaacccaugcaaacaacaccgucagcaacuucaaacgauuccacggacgugccuucaacgacccguuuauacaaaaagaaaaagaaaaccuauccuacgaccuagucccccucaagaauggaggcgugggcaucaaaguuauguauaugggagaagaacacuuguucucaguagaacagauaaccgccaugcuacuaacaaaacugaaggaaaccgcagagaacagucugaagaaaccugucaccgacugcguaaucuccguacccuccuucuucaccgacgcagaacggagauccguacuagacgcagcccaaauaguaggccuaaacugccuccgcuugaugaacgauaugacggccguagcacucaacuaugggauuuacaaacaagaccucccaagccucgacgaaaaaccccgcauaguagucuucgucgacaugggacacucagcauuccagguaagcgcaugcgccuucaacaaaggaaaacucaaagucuuaggcacggcuuucgaccccuuccuaggcgggaaaaauuucgacgagaaacucgucgaacacuucugcgccgaguucaaaaccaaauacaaacucgacgcaaagagcaaaauccgagcccuccuacgcuuauaccaggaaugcgaaaagcuaaagaaauugauguccuccaacuccaccgaccuacccuuaaacaucgaauguuucaugaacgacaaggacgucagcggaaagaugaacagaucccaguucgaggagcucugcgccgaguuauuacaaaagauagaagucccccucuacagccuucucgaacagacccaccucaaaguagaagacguuucagccgucgaaaucgucggcggagcaacacgcauccccgcggucaaagaacgcaucgccaaauucuucgggaaggacauauccaccacccuaaacgcagacgaagcaguggcacgcgggugugcccuccagugcgccaucuuaagccccgcauucaaaguacgagaguucucaguaaccgaugccgucccguucccaauaagccugauauggaaccacgacagcgaggacaccgaagguguccacgaagucuucagucgaaaccacgcggccccauucucaaaaguauuaacguuccuccgacgcggacccuucgaacucgaagcauucuacagcgacccgcaaggcguaccguacccugaggcaaagauuggcagguucguaguccagaacgucuccgcacaaaaagauggcgagaaaagccgcguaaaggucaaaguccgagucaauacacacggaaucuucaccauuuccaccgccucaaugguagaaaaaguccccacagaagaaaacgagaugagcucugaagccgacauggagugccucaaccaacgcccacccgaaaaccccgacaccgacaagaacguccaacaagacaacagcgaagcaggaacccagccccaaguccaaaccgacgcacaacagaccagccagagcccacccucccccgagcucacaucagaagaaaauaagaucccagacgcagacaaggccaacgaaaagaaagucgaccagcccccggaggccaagaaacccaaaaucaaaguggucaacguagaacuccccaucgaagcaaaccuggucuggcagcuagguaaagacuuauuaaacauguacaucgaaaccgaaggcaaaaugauaaugcaagauaaacucgaaaaagaacgcaacgacgccaaaaacgcagucgaagaauacguauacgaguuccgggacaaauuaugcggcccauacgaaaaauucaucugugaacaagaccaccaaaacuuucuacguuuauuaaccgaaaccgaagacuggcucuacgaagaaggcgaagaucaagcaaaacaggcuuacgucgauaaacucgaagaacuaaugaaaaucggaacgccggucaaagugcgguuccaagaagcagaagaacgucccaaaauguucgaggaacucggacaaagacuccaacacuacgcgaaaaucgccgccgacuuccgcaacaaagacgagaaguacaaccacaucgacgaaucagaaaugaagaaaguagaaaagucggucaacgaaguaauggaauggaugaacaacguaaugaacgcccaagccaaaaagucccucgaccaagacccagucguccgagcacaagaaaucaaaaccaaaauuaaggaacucaacaauaccugcgagcccgucguaacgcaaccgaaaccaaaaauagaaucccccaaacucgaacgaacccccaacgggccgaacaucgacaagaaagaagaagaccucgaggacaaaaacaacuucggagcagaaccaccacaccaaaacggcgaaugcuacccaaacgagaaaaacagcgucaacauggaccucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5714 - RNA, 3382 nt, Artificial Sequence
  mRNA product Design2 comprising derived and/or modified sequence from Homo sapiens__NP_006380.1 __HsHYOU1 (opt10)
ggggcgcugccuacggagguggcagccaucuccuucucggcaucaagcuuaccauggccgauaagguccgccgccaacgcccccgccgcagggugugcugggcgcucgucgccgucuugcucgccgauuuacucgccuuaucggacaccuuagccgucaugagcgucgauuuagggucggaaaguaugaaagucgcgaucgugaagccgggggucccgauggagaucgugcucaacaaagagagcagacgcaagacccccgucauagucacguuaaaggagaacgagcgcuuuuucggggauucggccgccucgauggccaucaaaaacccgaaagccaccuugagguauuuucaacauuuguuaggcaaacaagccgacaauccgcacgucgccuuguaucaagcgagguuucccgaacaugaauuaaccuuugauccgcaacgccaaaccguccauuuccaaauaucgagccaauuacaauuuagcccggaagagguccucgggauggucuugaacuacagcaggagcuuggccgaggacuucgccgaacaaccgauaaaagacgccgucauaacggucccgguguuuuuuaaucaagcggaaaggagggccgucuuacaagccgccaggauggccggguugaaggucuuacaauugauaaacgauaauacggcgaccgcguugucguacgggguguuuaggagaaaggacaucaauacgaccgcgcaaaacauaauguuuuacgauauggggagcgggucgacggucuguacgaucgucacguaucaaauggucaaaaccaaagaggccggcaugcaaccgcaauuacaaauaagaggggucggguucgauaggacguuaggcggguuagaaauggaauugagauugagggagagguuagccggcuuguuuaacgaacaaaggaaagggcaacgcgccaaagacgucagagaaaaucccagggcgauggcgaaauuauuaagggaagccaacagauugaagacgguguugucggcgaaugccgaucauauggcccaaaucgagggguuaauggacgacgucgauuuuaaagccaaggucaccagggucgaguucgaagaacucugcgccgaucucuucgaaagagucccgggcccgguccaacaagcguugcaaucggcggagaugucguuagacgaaaucgaacaagucauauuagucgggggcgcgaccagagugccgcgcguccaagaagucuuauuaaaagcggucgggaaagaagaauuaggcaaaaauauaaacgccgacgaggccgcggcgaugggcgccgucuaucaagccgccgccuugucgaaggcguucaaggucaaaccguucguggugagggacgccgucguguauccgauauuagucgaauuuacccgcgaagucgaagaagaaccgggcauccauucguuaaaacauaacaagagagucuuguuuagcagaaugggcccguauccgcagaggaaggugauaacguucaauagguauucgcacgacuuuaauuuucauauaaauuauggggauuuaggguuuuuaggcccggaggacuugagagucuucgggagucaaaacuuaacgaccgucaaauugaagggcgucggggauucguuuaaaaaauacccggauuaugaaaguaaagggauaaaagcccauuuuaauuuagacgaaucgggggucuugucguuggaucgcgucgaaagcgucuucgaaaccuuagucgaagauucggccgaggaagagagcaccuugacgaaguuggggaauacgaucaguucguuauucgggggggggacgaccccggacgcgaaagaaaacgggaccgacaccgugcaagaagaggaagaaucgccggccgaaggcucgaaagaugaaccgggcgaacaagucgaauugaaagaagaggccgaagcgccggucgaagacgggagccaaccgccgccgccggagccgaaaggggacgccacgccggaaggggagaaagcgaccgagaaggagaacggcgauaaaagcgaagcgcaaaagccgucggaaaaagccgaagccggcccggaagggguggccccggcgccggaaggggaaaaaaaacaaaaaccggcgcgcaaaagaaggauggucgaagaaauaggcgucgaauuagucgucuuagauuuaccggaucucccggaagacaaauuagcccaaagcguccaaaaguugcaagaucucaccuugagggauuuagaaaaacaagagagagagaaggccgcaaauucgcucgaggccuuuaucuucgaaacgcaagauaaauuauaucaaccggaauaucaagaggucaguaccgaagaacaaagggaagaaauaagcggcaaauugucggcggccaguacgugguuagaagacgaaggggucggggcgacgaccgucaugcucaaagaaaaauuagccgaauuacgcaaauuaugucagggcuuauucuucagagucgaagaaaggaaaaaauggccggagagauuaagcgcguuggacaacuuguugaaucacaguucgauguuuuugaaaggcgcgagauugauaccggaaauggaucaaauauuuaccgaagucgaaaugaccacccucgaaaaggugauaaacgaaacgugggcguggaaaaacgccaccuuagcggaacaagccaaauuaccggcgaccgaaaaaccgguccucuugagcaaggauaucgaggccaaaaugauggcguuagauagggaaguccaauacuuauugaacaaagcgaaauucacgaaaccgagaccgagaccgaaagauaaaaacggcacgagagccgaaccgccguugaacgcgucggcgucggaucaaggcgaaaaagugauaccgccggccgggcaaaccgaggacgccgaaccgaucagcgagccggaaaaggucgaaaccgggagugaaccgggggauaccgaaccgcucgaacucggggggccgggggccgagccggagcaaaaggagcagagcaccgggcaaaaaagaccgcucaaaaaugaugaguugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5715 - RNA, 2581 nt, Artificial Sequence
  mRNA product Design2 comprising derived and/or modified sequence from Homo sapiens__NP_005339.3 __HsHSP90AA1 (opt10)
ggggcgcugccuacggagguggcagccaucuccuucucggcaucaagcuuaccaugccggaggagacgcaaacgcaggaucagccgauggaggaagaggagguagagacauucgcauuccaggcggagauagcacaauuaaugucguuaauaauuaacacguucuacaguaacaaggagauauucuuaagggaguuaauaucgaacucgucggacgcguuggacaaaauacgauacgaaucguuaacggacccgucgaaguuagacucggguaaggaguugcacaucaacuuaauuccgaacaagcaggaccggacguuaacgauaguagacacggguauaggaaugacgaaagcggacuugauaaacaacuuaggaacgauagcgaagucggguacuaaggcguucauggaggcauuacaggcgggugcggacauaaguaugauaggucaauucggggucggauucuacucggcauacuuagucgcagagaagguaacgguaaucacgaagcacaacgacgacgaacaauacgccugggagaguucggcgggugguaguuucacgguacgcacugacacgggugagccgauggguagggguacgaagguaauauuacacuuaaaggaggaccagacggaauacuuagaggagcgccggaucaaggagauuguuaaaaagcacucgcaauucaucggcuacccuauaacguuauucgucgagaaggagcgcgacaaggagguuagugacgacgaggcggaggagaaagaggacaaggaggaggagaaggaaaaggaggagaaggagucggaggacaagccggagauagaggacguaggaucggacgaggaggaggagaagaaggacggggacaaaaagaagaagaaaaagauaaaggagaaauacauagaccaagaggaguuaaacaagacgaagccgaucuggacaaggaacccggacgacauaacgaacgaggaguacggugaguucuacaagucguuaacaaacgacugggaggaccacuuagcggucaaacacuucaguguagaggggcaguuagaguuccgcgcguuguuauucguaccgaggcgcgcgccguucgacuuauucgagaaccggaagaagaaaaacaauauaaaguuauacguccgaaggguauucauaauggacaacugcgaggaguuaauuccggaguaccucaacuucauacgcggugucgucgacucggaagacuugccguuaaacaucucgcgagagauguuacagcagucgaagaucuuaaagguaauacgcaagaacuuagucaagaagugcuuagaguuauucacggaguuggcagaggacaaggagaauuacaaaaaauucuacgagcaguucucgaagaauauaaaguuagggauacacgaggacagucagaaccgaaaaaaguuaucagaauuauuacgauacuauacgagugcgucgggggacgaaauggucaguuugaaggacuauuguacacggaugaaggaaaaccaaaagcacauauacuacauaacgggggagacgaaggaccaaguugcgaacucggcauucgucgagcgcuuacggaagcacggguuagaggucauauacaugaucgaaccuauagacgaguauugcguacagcaauugaaggaguucgaggggaagacauuaguaaguguaacaaaggagggguuagaguugccggaggacgaggaggagaagaagaagcaggaggagaagaagacgaaguucgagaacuuaugcaagauaaugaaggacauauuagagaagaaggucgagaaggucgucgucucuaacagguugguaacgucgccgugcugcauaguaacgucgacuuacgguuggacugcgaacauggaacgaauaaugaaggcgcaggcguuaagggacaacaguacgauggguuacauggcggcaaagaagcauuuagaaaucaacccggaccacucgaucauagagacguuacgacagaaggcggaggcggacaagaacgacaagagugucaaagacuuaguaauauuauuauacgagacggcguuguuaucgaguggguucucguuagaggacccacaaacucacgcgaaccgaauauaucgcaugauaaaguugggauuaggaaucgacgaggacgacccgacggcggacgacacaucggcggccguaaccgaggagaugccgccguuagagggugacgacgauacuucgcggauggaggagguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5716 - RNA, 2557 nt, Artificial Sequence
  mRNA product Design2 comprising derived and/or modified sequence from Homo sapiens__NP_031381.2__HsHSP90AB1 (opt10)
ggggcgcugccuacggagguggcagccaucuccuucucggcaucaagcuuaccaugccggaggagguccaucauggcgaggaagagguggagacguuugcguuucaagcggaaaucgcgcaguugaugucgcucauaaucaauacguuuuauaguaauaaggagauauuuuugcgcgaacucaucagcaaugccucggaugcguuagauaaaauccgcuaugagucguugaccgauccgagcaaguuagauagcgggaaagaacucaagaucgauauaauaccgaauccgcaggagaggaccuugacguuggucgauacggggaucgggaugaccaaggcggauuugaucaauaacuuggggaccaucgcgaaaucgggcaccaaggcguuuauggaagcguugcaggccggggcggauaucucgaugauagggcaguuuggggucggguuuuauucggccuauuugguggcggagaaagucgucgucauaaccaagcauaaugaugaugagcaguaugcgugggagucgucggcggggggcucguuuaccgugcgcgccgaucauggggagccgaucgggaggggcaccaaggucauauugcauuugaaagaggaucagacggaguaucucgaggaaaggcgcgugaaagagguggugaagaagcauucgcaauuuauaggguauccgaucacguuguauuuagagaaggaacgcgagaaagagaucucggaugaugaagcggaagaggagaagggggagaaggaggaggaggauaaggaugaugaggagaaaccgaaaauagaggaugucgggucggaugaggaggaugauagcgggaaagauaaaaagaagaagaccaagaagauaaaggaaaaguauauagaucaggaggaauuaaauaagaccaagccgauauggacgcgcaauccggacgauauaacccaggaggaguauggcgaguuuuauaagagcuugaccaaugauugggaagaucauuuggccgucaaacauuuuucggucgaggggcaguuggaguuucgcgccuuguuguuuauaccgcgccgcgccccguuugauuuauuugagaauaaaaagaagaagaauaauaucaaauuguaugugaggaggguguuuaucauggauagcugugaugaguuaauaccggaguauuugaauuuuauaagaggggucgucgauagugaggauuugccguugaauauaucgagggagauguugcagcaaucgaaaaucuuaaaggucauacgcaagaauauagucaagaaauguuuggaguuguuuucggagcucgccgaagacaaggagaauuauaaaaaguuuuaugaggcguuuucgaaaaauuugaaguuagggauccaugaggauucgacgaacaggcgcagguugucggaguuguugcgcuaucauaccucgcaaucgggggaugaaaugaccucguugagugaguaugucucgagaaugaaggagacccagaaaagcaucuauuauauaacgggggaaucgaaagagcaggucgccaauagcgccuuuguggagagggucaggaaaaggggguuugagguggucuauaugaccgaaccgauagaugaauauugcguccagcaauugaaggaguuugaugggaagucguuggugagcgucacgaaggagggguuggagcucccggaggaugaggaggaaaaaaagaagauggaggagagcaaggcgaaguuugaaaaucucuguaaauuaaugaaggaaauauuggauaagaaagucgagaaagugaccauaagcaauagauuagucucgagcccguguuguauagugaccucgaccuauggguggaccgccaauauggagaggaucaugaaggcccaggcguugcgcgauaauagcacgaugggcuauaugauggcgaaaaagcauuuggagaucaauccggaucauccgaucgucgagaccuugcgccagaaagcggaggccgauaagaaugauaaggcggucaaggauuuggucguguuauuguuugagaccgcguuguugagcucgggguucagcuuagaagauccgcagacgcauucgaaucgcauauauaggaugaucaaauugggguuagggaucgaugaagaugaggucgcggccgaggaaccgaaugccgccgugccggaugagauacccccguuagagggcgaugaagaugccagccgcauggaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5717 - RNA, 2794 nt, Artificial Sequence
  mRNA product Design2 comprising derived and/or modified sequence from Homo sapiens__NP_003290.1__HsHSP90B1 (opt10)
ggggcgcugccuacggagguggcagccaucuccuucucggcaucaagcuuaccaugcgcgcguugugggucuuggguuuguguugugucuuguugacauuugggagcgugagggccgaugaugaaguggauguagaugggaccguggaggaagauuuggggaagucgagggaggggucgagaaccgacgaugaagugguacaaagggaagaggaagccauccaauuggacggguugaaugcgucgcaaaucagggaauugagagaaaaaucggagaaauucgcguuucaggcggaggugaaucgcaugaugaaguugauuauaaauaguuuguauaagaacaaggaaaucuuuuuaagagaguugauaaguaaugcgucggacgcgcucgacaaaaucagguugauaucguuaaccgaugagaacgcgcucucgggcaaugaagaguugacggucaagaucaaaugugauaaagaaaaaaauuuauugcacgucaccgauacaggggucgggaugacgagggaggaauuggugaagaauuuggggacgaucgcgaaaucggggaccucggaauuuuugaauaagaugaccgaagcgcaagaggaugggcaaagcaccucggaauugaucgggcaauuuggcgucggcuuuuauucggccuuuuuggucgccgauaaagucaucgugaccucgaagcauaauaaugacacgcaacauauuugggaaagcgauucgaaugaguucucggucauagccgaucccagagggaauaccuuggggcgcgggacgacgauaaccuuggucuugaaagaggaagccagcgauuauuuggaguuagauaccauaaagaauuuggucaaaaaguacucgcaauuuauuaauuuucccaucuauguguggucgagcaaaaccgagaccgucgaagaaccuauggaagaagaagaagccgcgaaggaggaaaaggaggagagcgacgaugaggccgccguggaagaggaggaagaggaaaagaaaccgaaaacgaaaaaggucgaaaagacggucugggauugggaguugaugaacgauauuaagccgaucuggcaaaggcccucgaaggagguggaagaggaugaauauaaggcguuuuauaaaucguuuucgaaagagucggacgauccuauggcguacauccauuucaccgcggagggggaagucaccuuuaagucgauauuguuugugccuaccucggcgccgcgcggguuguucgaugaguauggcucgaaaaaaucggauuauauaaaguuguauguaaggagagucuuuauuacggaugauuuucaugauaugaugccgaaauauuuaaauuucgugaaaggggucgucgacagcgacgauuuaccguugaacgucucgcgcgaaaccuugcaacaacauaaguuauugaaagucaucaggaaaaaauuggugcgcaagaccuuggauaugauaaaaaaaaucgccgacgacaaauauaacgauaccuuuuggaaggaauuugggacaaauauuaaguugggggucauagaggaucauucgaacaggacccgcuuggccaaguuguugcgcuuucaaucgucgcaccauccgaccgauaucaccucguuagaucaauacgucgagaggaugaaagagaagcaagauaagauauauuuuauggccgggaguucgaggaaggaagccgagucgucgccguucgucgaaagguuguugaaaaaaggguacgaggugauauaucucacggagccggucgaugaguauuguauacaagcguugccggaauuugaugggaaacgcuuucaaaacguggccaaagagggggucaaauuugaugagucggaaaaaaccaaagaaagccgcgaggccguggaaaaggaauuugaaccguuauugaauuggaugaaggauaaggcauugaaagauaaaaucgagaaagccgucgucagccaaagauuaacggaaucgccgugcgcguugguggcaucgcaauauggguggucggguaauauggaacgcauaaugaaagcccaagcguaucaaaccgggaaagauauaucgacgaauuauuaugcgucgcaaaaaaaaaccuuugagauaaauccgcgccaucccuugauucgcgauauguugaggcgcauaaaagaggaugaagacgauaaaacggucuuggauuuggcaguagucuuguuugagaccgcgaccuugcgcucgggguauuuauugccggauaccaaggcguauggggauaggauagagaggauguugcgcuugucguugaauaucgauccggacgccaaagucgaggaagaaccggaagaagaaccggaggaaaccgccgaagauacgacggaagauaccgaacaagaugaagacgaagaaauggacguagggaccgaugaggaagaggagacggccaaagagagcacggccgagaaagaugaguugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5718 - RNA, 2497 nt, Artificial Sequence
  mRNA product Design2 comprising derived and/or modified sequence from Homo sapiens__NP_057376.2__HsTRAP1 (opt10)
ggggcgcugccuacggagguggcagccaucuccuucucggcaucaagcuuaccauggcgagggagcucagggcguuguuguugugggggaggagguugaggccguuguugagggcgccggccuuggcggccgugccgggggggaagccgaucuuguguccgaggcgcaccaccgcccaguuggggccgaggaggaauccggcguggagcuugcaagcggggagguuguuuaguacccagacggcggaggauaaggaggagccguugcauucgaucauaucgucgacggaaaguguccaggggucgacgaguaagcaugaauuucaagcggagacgaaaaaguuguuggauauagucgcgaggucguuguauagugagaaggagguguuuauaagggaguugauaagcaaugccagugaugccuuggagaaguugaggcauaaguuggucagcgaugggcaggccuugccggagauggagauccacuugcagacgaaugccgagaaggggacgaucaccauccaggauaccgggaucgggaugacccaagaagaguuggugagcaauuuggggaccaucgcgaggucggggucgaaggcguuuuuggaugcguugcagaaucaggcggaggcgaguaguaagauaauagggcaauuuggggucggguuuuacagugcguuuauggucgccgauaggguggaggucuacagcaggagcgccgcgccggggaguuugggguaucagugguugagugaugggucgggggucuuugagaucgccgaggcgagcggggugaggaccgggacgaagauaauaauccauuugaagucggauuguaaggaguucucgagcgaggcgagggugagggauguggugacgaaguacagcaacuuugugagcuucccguuguacuugaaugggcgcaggaugaauaccuugcaggcgauauggaugauggauccgaaggaugugagggaguggcaacacgaggaauuuuauagguaugucgcccaggcccaugauaagccgagguauacguugcauuauaagaccgaugcgccguugaauauaaggaguauauuuuauguccccgauaugaagccgucgauguuugaugucaguagggaguuggggagcagcgucgccuuguauagccgcaagguguugauccagaccaaggcgacggauauauugccgaagugguugagguuuauacgcggggugguggauucggaggauauaccguugaauuugagcagggaguuguugcaggagagugcgcucauaaggaaguugagggaugucuugcagcaaagguugaucaaguuuuuuauagaccagaguaaaaaggacgccgagaaguaugcgaaguuuuuugaggauuauggguuguuuaugagagaggggauagucaccgccacggaacaggaagugaaggaagauaucgccaaguuguugcgcuaugaaaguucggcguugccgagcgggcaguugaccucguugucggaguaugcgagcaggaugcgcgccgggacgaggaauauauauuauuugugugcgccgaauaggcauuuggccgagcauagcccguauuaugaagcgaugaagaaaaaggauacggagguguuauuuuguuucgagcaguuugaugaguuaacguuguugcauuugcgcgaauuugauaagaaaaaguugauaucgguggaaaccgauauaguggucgaucauuauaaggaggagaaguuugaagauaggucgccggcggccgaguguuugagcgagaaggagacggaggaguugauggcguggaugagaaauguguuggggagucgcgucacgaaugucaaggugaccuugcgcuuggauacgcauccggcgauggugacggucuuggagaugggggccgcgaggcauuuuuugaggaugcagcaguuggccaagacccaagaagagagggcgcaguuguugcagccgacguuggagaucaauccgaggcaugcguugaucaaaaaguugaaccaguuacgcgcgagugaaccgggguuggcgcaguuguugguggaucaaauauaugagaaugcgaugauagccgccggguuggucgaugauccgagggcgauggucgggagguugaacgaguuguuggugaaggccuuggaaaggcacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5719 - RNA, 844 nt, Artificial Sequence
  mRNA product Design2 comprising derived and/or modified sequence from Homo sapiens__NP_000609.1__HsIGF1 (opt10)
ggggcgcugccuacggagguggcagccaucuccuucucggcaucaagcuuaccauggguaagaucucgucauuaccgacgcaguuguucaagugcugcuucugcgacuucuuaaagguaaagaugcacacgaugucgaguucccacuuauucuacuuggccuuaugcuuguugacguucaccuccucggcgaccgcagggccggagaccuugugcggcgcggaguuaguagacgcguuacaguucgucugcggugaccgagguuucuacuucaacaagccgacggguuacggguccucgucgcgccgugcaccgcagacgggcaucguugacgaaugcugcuuccguucuugcgaccuccgucgcuuagagauguacugcgcgccguugaagccggcgaagucggcccguucgguacgcgcgcagcggcacacggacaugccaaagacgcagaaagagguccacuuaaagaacgcgucgcguggaucggccggcaacaagaacuaccggaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5720 - RNA, 925 nt, Artificial Sequence
  mRNA product Design2 comprising derived and/or modified sequence from Homo sapiens__NP_000603.1__HsIGF2 (opt10)
ggggcgcugccuacggagguggcagccaucuccuucucggcaucaagcuuaccaugggcauacccauggguaagucaauguugguguuauuaaccuucuuagccuucgccucgugcugcaucgcggccuaccguccgucagagacccuaugcggcggggagcuaguagacacgcuacaguucgugugcggcgaccggggguucuacuucucgcgccccgcgucgcgcgugucccgccguucgcgcggcaucguagaggagugcugcuuccgaucaugcgacuuggccuuauuagagaccuacugcgccaccccggccaagucggagcgagacgugucgacgccgccgaccguguuaccggacaacuucccccgguaccccgucggcaaguucuuccaguacgacacguggaagcagucgacucagagacuucgucgcggguuaccggcguuguugcgugcccgacgaggccacgugcuagccaaggaguuagaggcguuccgcgaggcgaagcggcaccgcccguuaaucgcguuacccacucaggaccccgcgcacggaggcgccccgcccgagauggcgucgaaccgaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5721 - RNA, 1021 nt, Artificial Sequence
  mRNA product Design2 comprising derived and/or modified sequence from Homo sapiens__NP_000591.1__HsIL6 (opt10)
ggggcgcugccuacggagguggcagccaucuccuucucggcaucaagcuuaccaugaacucguucaguacgucggcguucggccccgucgcguucucguuagguuuguuauuggucuuaccggcggcguucccagcgcccguuccaccgggugaggacucgaaggacguugcggcgccccaccgacagcccuugaccucguccgagcguaucgacaagcagauccgauacaucuuagacgguauaagugcguuacgcaaggagacgugcaacaaaucgaacaugugcgagaguucgaaggaggcguuagccgagaacaaccucaacuugccgaagauggcggagaaggacgggugcuuccagaguggguucaacgaggagacaugcuuaguaaagaucauaacgggccuccuugaguucgaggucuaccucgaguacuuacagaacagguucgagucaucggaggagcaggcacgcgcgguucaaaugucgacgaagguauugauccaguuccuccagaagaaggccaagaacuuagacgcgaucacgacgccggacccgacuaccaacgcgaguuuguuaacuaaguuacaggcgcagaaccagugguugcaggacaugaccacccacuugaucuugcggucguucaaggaguucuugcagaguucuuuaagagcguuaaggcagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5722 - RNA, 1663 nt, Artificial Sequence
  mRNA product Design2 comprising derived and/or modified sequence from Homo sapiens__NP_002183.1__HsINHBA (opt10)
ggggcgcugccuacggagguggcagccaucuccuucucggcaucaagcuuaccaugccguuauugugguuaaggggguucuuguuagcgucgugcuggaucaucgugcguucgucgccgacgcccgggucggagggucacucggccgcaccggacugcccaaguugcgcacuugccgcguuaccgaaggacguuccgaacucgcagccggagaugguugaggccgugaaaaagcacauauugaacauguuacaccuaaagaagcgaccggacguaacgcagccgguccccaaagcggcccuauuaaacgcuauacggaaguuacacguugggaagguaggcgagaacgguuacguggagaucgaggacgacaucgggcgccgcgccgagaugaacgaguuaauggagcagacgucagagaucaucaccuucgcggagucgggcacugcgcguaagacuuugcacuucgagaucucgaaggaggguucggacuuaucggugguagagcgggccgaggugugguuauucuugaaggugccgaaggcgaaccgaacgcgaaccaaggucaccauccgauuguuccagcaacagaaacacccccaggggaguuuagacaccggggaggaggccgaggagguaggucucaagggggagcgauccgagcuccucuuaucggagaagguggucgacgcgcgaaagucuacguggcacguauucccggugucgucgucgauccagcgccuacuugaccagggcaagaguucguuggacguccgcauagcgugcgagcagugccaggagucgggcgcgucucuuguauuguuagggaagaagaagaagaaggaggaggagggugaggggaagaagaaggggggcggggagggcggggcgggcgcggacgaggagaaggagcagucucaccggccguucuuaauguuacaagcgcgucaaucggaggaccacccgcaccgacgacgccgacguggguuagagugcgacggcaaggugaacaucugcugcaagaagcaguucuucguuucauucaaggacaucgguuggaacgacuggauaauagccccgucgggguaccacgcgaacuacugcgagggcgagugcccgucccacaucgccgguacuucgggcucgucguuaucguuccacaguacgguuauaaaccauuaccguaugcguggacacucccccuucgcgaacuugaagaguugcugcgugccgaccaaguugcgucccaugucgaugcuuuacuacgacgacggccagaacauuauaaagaaggacauccagaacaugaucgucgaggaaugcggcugcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5723 - RNA, 1606 nt, Artificial Sequence
  mRNA product Design2 comprising derived and/or modified sequence from Homo sapiens__NP_002184.2__HsINHBB (opt10)
ggggcgcugccuacggagguggcagccaucuccuucucggcaucaagcuuaccauggacgguuuaccgggacgagcuuugggugcggcuuguuuguuauuguuggcagcggguugguuaggcccggaagcguggggaucgccgacaccucccccuacuccggcggcgccaccgcccccgccaccgccggggucgccaggcgggucccaagauacuugcacaaguugcggggguuuccgacgacccgaggaauugggacgcguagacggugauuucuuggaagcuguaaagcgucauaucuuaucgcguuuacagaugcgagggcgaccgaacauaacccacgccguaccgaaggcggcgaugguuaccgcguuacgaaaguuacaugcugggaagguucgugaggacgggcguguagagaucccccauuuggacgggcacgccucgccaggggccgacgggcaagagcgagucucggagauaauuaguuucgcggagacugacggguuagcgucgucgaggguacguuuauacuucuucauaucgaacgaggguaaccaaaacuuguucguaguacaggcgaguuuaugguuauaccuuaagcuauuaccauacguuuuagagaaggggucgcgucgaaaaguaaggguaaagguauacuuccaagagcaaggucacggcgaccgauggaacaugguagagaagcggguugaccuuaagcgaaguggauggcacacguucccguuaacugaggcaauacaggcauuauucgagcguggagagcgccgcuuaaacuuagacguacaaugcgacucgugccaggaguuggcagucgucccaguauucguagaccccggggaggagagucaucgaccguucguaguaguacaggcgcgcuuaggugacucgcgacaccgaauccggaagcgugguuuagagugcgacgguaggacgaacuugugcugccgacagcaguuuuuuauagacuuuagguugaucggguggaacgacuggauaauugcgccgacaggauacuacgguaacuauugcgaaggaaguugcccggcguacuuagcgggggugccagguucggcaucgucguuccacacugcgguaguuaaccaguaccgaaugcgaggauugaauccggggacaguaaacucgugcugcaucccgacgaaguuaaguacgaugucgauguuauacuucgacgacgaguacaacauaguaaagcgcgacgucccgaacaugaucguagaagagugcgguugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5724 - RNA, 3841 nt, Artificial Sequence
  mRNA product Design2 comprising derived and/or modified sequence from Homo sapiens__NP_000623.2__HsITGAM (opt10)
ggggcgcugccuacggagguggcagccaucuccuucucggcaucaagcuuaccauggcguugaggguccucuuauugaccgccuugaccuuaugccauggguuuaauuuggauacggagaacgccaugacguuucaggagaaugccaggggguuugggcagagcgucgugcaguugcaggggagcagggucguggugggggcgccgcaggaaaucguggccgccaaucagagggggagcuuguaucagugugauuauagcacgggcagcugugagccgauacgcuuacaggugccgguggaggccgugaauaugucguuaggguugucguuggcggcgaccacgagcccgccgcaguugcucgccugugggccgacggugcaccaaacguguagcgagaauacguaugucaagggguuguguuucuuguucggcaguaauuugaggcaacaaccgcagaaguuuccggaggcguugagggggugcccccaggaggauucggauaucgcguucuugaucgaugggagugggaguaucaucccgcaugauuuuaggagaaugaaagaguucgugagcaccgucauggagcaguugaaaaagaguaagaccuuguuuaguuuaaugcaguauucggaagaauuucgcauacauuuuacguuuaaggaauuucaaaauaauccgaauccgaggagcuuagucaagccgaucacccaguuguuggggcgcacccauaccgcgaccgggauacgcaaaguggucagggaguuguuuaauaucaccaacggggccaggaagaaugcguuuaagauauuggucgugaucacggauggggagaaguuuggcgauccgcucggguaugaggaugucauaccggaggccgaucgcgaaggggucauaagguaugugauaggggucggcgaugcguuuaggucggagaagaguaggcaagaguugaauaccaucgcgaguaagcccccgagggaucauguguuucaggugaauaauuuugaggcguugaagacgauacagaaucaguugagggaaaagaucuuugcgaucgaggggacgcagacggggucgaguucgaguuuugagcacgagaugagucaggagggguuuucggcggccauaacgaguaaugggccguuguugagcacgguggggagcuaugauugggccggggggguguuuuuguauacgaguaaagagaagaguaccuuuauaaauaugacgcgcguggacagcgauaugaaugaugccuacuugggguaugcggccgccauaaucuugaggaaucgcguccagagcuugguccucggggcgccgagguaucagcauauaggguuggucgccauguuuaggcagaauacgggcaugugggagucgaaugccaaugugaaagggacgcagauaggggccuauuuuggggccagcuuguguagcgucgauguggauagcaaugggucgaccgacuuggucuugauaggggccccgcauuauuacgaacaaaccaggggggggcaggucagcgugugcccguugccgagggggagggcgagguggcagugugaugccgucuuguacggggagcaggggcagccgugggggcgcuuuggggcggccuugacgguguugggggaugugaauggggauaaguugacggaugucgccauaggggccccgggggaagaggauaauaggggggccgucuauuuguuucaugggacgagugggucggggauaagcccgagucauagccagaggaucgcggggagcaaguuaaguccgcgcuuacaguauuuuggccagucguugaguggggggcaggauuugaccauggauggguuggucgacuuaaccgucggggcccagggccacgucuuguuguugaggagucagccggucuugagggugaaagccauaauggaauuuaacccgagagagguggccaggaauguguuugaguguaaugaucaggucgugaaagggaaggaggcgggggaggugcgcgucugcuuacauguccagaaaucgaccagggacagguuaagggaggggcagauacaaagugucgugacguaugauuuggcguuggauagugggcgcccgcauucgagggcgguguuuaaugagacgaagaacagcacgaggagacagacgcaagucuugggguugacgcagaccugugaaaccuugaaguugcaguuaccgaauugcauagaggauccggugagcccgauagucuugagguugaacuucaguuugguggggaccccguugagcgccuuugggaauuugaggccgguguuggcggaggaugcgcagagguuguuuacggcguuguuuccguuugagaaaaauugugggaaugauaauaucugccaggaugauuugucgauaacguuuagcuuuaugagcuuggauuguuuggucgucggggggccgagggaguucaaugugaccgugacgguccgcaaugauggggaagacaguuaucgcacccaggucaccuuuuuuuuucccuuggauuugagcuauaggaaggugagcacguugcagaaucagaggagccagaggagcuggcgcuuggccugcgagagcgcgagcagcaccgaggucucgggggcguuaaagagcacgaguugcaguaucaaucauccgauauuuccggaaaauucggaggugaccuuuaauaucaccuuugaugucgauagcaaggccagcuuggggaauaaguugcucuuaaaggcgaaugugacgucggagaauaauaugccgcgcaccaauaagaccgaauuucaguuggaguugccggugaaauacgcggucuauaugguggugacgucgcauggggucaguaccaaguauuugaauuucacggcgucggagaauaccagucgcgucaugcagcaucaguaucaagucaguaauuuggggcagaggucguugccgauaaguuuggucuuuuuggucccggugcgcuugaaucaaaccgucaucugggauaggccgcaggucaccuuuagcgagaauuugaguaguaccugccauaccaaggagagguugccgucgcacagugauuucuuggccgaauugaggaaggcgccggucgucaauuguagcauagccgucugucaaaggauccaaugugauaucccguuuuucggcauccaagaggaauuuaaugccaccuugaaggggaauuugucguuugauugguacauaaaaacgagccacaaucauuuguugaucgucaguaccgcggagauauuguuuaaugauucgguguuuacccucuuaccggggcagggggccuuugucaggagccaaaccgagaccaaggucgagccguuugaggugcccaaucccuugcccuugauaguggggaguagugucgggggcuuguuguuguuggcguugauaaccgccgccuuauacaaauugggguuuuuuaaaaggcaguauaaggacaugaugagugagggggggcccccgggcgcggagccgcaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5725 - RNA, 1786 nt, Artificial Sequence
  mRNA product Design2 comprising derived and/or modified sequence from Homo sapiens__NP_002415.1__HsMMP8 (opt10)
ggggcgcugccuacggagguggcagccaucuccuucucggcaucaagcuuaccauguuuaguuuaaaaaccuugccguucuuauugcucuugcacguccaaaucaguaaagcguucccggucagcagcaaggaaaagaacaccaagaccguccaagauuauuuagagaaauuuuaucagcucccgucgaaucaauaccaaagcacccgcaaaaacgggaccaacgucauagucgagaaauugaaggagaugcaaagguucuucggccucaacgucaccggcaaaccgaacgaagagaccuuagauaugaugaagaaaccgaggugcggggucccggauucggggggguucaugcucacgccggggaauccgaaaugggagaggaccaaucucacguaucgcaucaggaauuacacgccgcaauuaagcgaagccgaagucgagcgcgccauaaaagacgcguucgaguuguggucggucgccagcccguugauauuuacgcgcauaagccaaggggaagccgacauaaauaucgccuucuaucagcgcgaccauggggauaacagcccguucgacgggccgaacgggauauuggcccacgcguuccaaccggggcaggggaucgggggggacgcccacuucgacgcggaggagaccuggacgaauacgagugccaacuauaaucucuucuuggucgccgcccacgaguucgggcacagccucggcuuggcccauaguagcgauccgggggcgcucauguacccgaauuacgccuuucgcgagacgucgaauuauagcuugccgcaggacgauauagacgggauccaagcgauauacggguugagcucgaauccgauacagccgaccgggccgucgaccccgaagccgugcgauccgucgcucaccuucgacgccauaacgaccuugaggggggagaucuuguuuuucaaggaucgcuauuuuuggcgccgccacccgcaauugcagcgcguggagaugaacuucaucagcuuguuuuggccgaguuugccgaccgggauccaagccgccuacgaggacuucgaucgcgauuugaucuuuuuguucaaggggaaucaguauugggccuuaucgggguacgacaucuuacagggguacccgaaagacaucagcaauuacggguuuccgucgucggugcaggccaucgaugccgccgucuuuuaucgcucgaagaccuauuuuuucgucaacgaucaguuuuggcgcuacgacaaucagcgccaguuuauggaaccgggguacccgaagucgaucagcggggcguucccggggaucgaaucgaaggucgacgccgucuuucaacaggagcacuuuuuucacguguuuucggggccgcgcuacuaugccuucgacuugaucgcccaacgcgucacgcgcgucgcccgcgggaacaagugguugaauugccgcuacgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5726 - RNA, 2506 nt, Artificial Sequence
  mRNA product Design2 comprising derived and/or modified sequence from Homo sapiens__NP_004985.2__HsMMP9 (opt10)
ggggcgcugccuacggagguggcagccaucuccuucucggcaucaagcuuaccaugucguuauggcaaccuuugguauugguauuauuggucuuagggugcugcuucgcagcgccgcgucagcgacagucgacauuagucuuguucccgggugacuuacgaaccaacuuaacugaucggcaauuagcugaagaguauuuauacagguacggcuacacgcgcguagcggagaugaggggggagucuaagaguuuaggcccagcauuacucuuguugcagaaacaguuaucguuacccgaaacgggggaauuagacucggcgacacucaaggcgaugcgcacuccucguugcggaguacccgacuugggacgauuucagacauucgagggugauuugaaguggcaccaccacaacauaacguacuggauccagaacuacucugaggacuuaccucgugcaguaauagacgacgcuuucgcacgagcguucgcuuuauggucggccguuacacccuugacguuuacgcgagucuauucgcgcgacgccgacauaguaauacaguucgggguagccgagcacggugacggcuacccauucgacgguaaggacgguuuauuagcgcacgcguucccgccggggccggguauccagggcgacgcgcacuucgacgacgacgaauuauggucuuuagggaaagggguaguuguaccuacgcguuucgguaacgcggacggugccgcaugccauuucccguucauauucgaggggcgaucauauagugcgugcacuacggacggacggucggacggguuacccugguguucgacuacugcgaacuacgacacggacgaccgauucgguuucugcccgucggagcguuuauacacgcaagacgguaacgcggacggcaagccuugccaguucccuuucauauuccagggacagucguacucggcaugcacaaccgacgggcggucggacggguaccgguggugcgcgacuacggcgaacuacgaucgcgacaaguuauucggguucugcccaacacgggcagacucuaccguaaugggagggaacagugccggagaguugugcguauuccccuucacguucuugggaaaagaguacucaacaugcacuucggaaggccggggugacggucgauuguggugcgccacuacgaguaacuucgacucggacaaaaagugggguuucuguccugaccagggcuauucguuauucuuaguagcagcacacgaguucgggcacgcauuaggauuggaccacaguaguguacccgaagcauugauguauccgauguaccgauuuacggaagguccgccguuacacaaggacgacguaaacgguauccgacacuuauacggcccacggccggagccggaaccgcgcccaccgaccacaacgacuccacagcccacugcaccgcccacaguauguccuacggguccuccgacaguacacccgucggagcgaccgacggcaggucccacuggaccgccgagugcagggccgacggggccgccgaccgcagguccgucgacggcgacaacggucccguuaucgcccguagacgacgcgugcaacguuaacauauucgacgcaauagcagagauagguaaccaguuauacuuauucaaggacggcaaguacuggcgcuuuucggaggggcgaggaagucgaccccaggggccguucuuaaucgcggacaaguggccggcauuaccucgaaaguuagauucaguauucgaggagcgauuaaguaagaaauuauucuucuucucggguaggcaaguauggguauauacgggugccuccguauuagggccccggaggcucgacaaguuggggcucggugcugacgucgcgcagguaacgggugcuuuacgcucgggucgaggaaagauguuauuauucaguggucgccgauuauggcguuucgacguaaaggcacagauggucgacccucgaucggcgucggaggucgaccguauguucccggguguaccguuagacacacacgacguauuccaguaccgcgaaaaggcuuacuucugccaggauagguucuacuggcgagucucgucgaggucggaauuaaaucaaguagaccagguaggguaugucacguacgacaucuuacagugcccggaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5727 - RNA, 1798 nt, Artificial Sequence
  mRNA product Design2 comprising derived and/or modified sequence from Homo sapiens__NP_002418.1__HsMMP13 (opt10)
ggggcgcugccuacggagguggcagccaucuccuucucggcaucaagcuuaccaugcacccgggcguguuagccgcguuuuuguuucucucguggacccacugcagagcguuaccguugccgucggggggggacgaggacgaccucagcgaagaggauuugcaauucgccgaaagguauuuacgcagcuauuaucacccgaccaacuuggccgggauauuaaaagaaaacgccgccucgaguaugaccgaacgcuugagggagaugcaaaguuuuuuugggcucgaagucaccgggaaguuggaugacaauacgcucgacgugaugaagaaaccgcgcuguggcgucccggacgucggggaguauaacgucuuuccgaggaccuugaaguggaguaagaugaaccucacguaucgcaucgucaacuauacgccggacaugacccacagcgagguggagaaagccuuuaagaaggcguuuaaggucuggagugacgucaccccguuaaacuucacgcgcuugcaugacgggaucgccgauauaaugauuagcuucgggaucaaagaacacggggauuuuuauccguucgacggcccgagcggguuauuagcccacgccuucccgccgggcccgaacuacgggggggacgcgcacuucgacgacgacgagacguggaccucgucgaguaagggguauaaucucuucuuggucgccgcccacgaauuugggcauagucucggguuggaucauaguaaagauccgggggccuugauguucccgauauauacguauacggggaagucgcauuucauguugccggacgaugacguccagggcauacaaaguuuguacgggccgggggacgaggauccgaauccgaagcacccgaagaccccggauaagugcgauccgagucucaguuuggacgcgaucacgucguugaggggggagaccaugauauucaaggaucgcuuuuuuuggagguuacacccgcaacaagucgacgccgaauuauuccucaccaagagcuucuggccggaguugccgaauaggaucgacgccgccuacgaacauccgagccacgauuugauauuuauauuucgcgggcgcaaguucugggccuugaacggguacgauaucuuagagggguacccgaagaagaucagcgaguuaggguugccgaaggaggucaaaaaaaucucggccgccguccauuucgaagacaccgggaaaaccuuguuauuuagcgggaaucaaguguggcgcuacgacgacaccaaucacaucauggacaaggauuacccccgcuugaucgaggaggauuuuccggggaucggggacaaggucgacgccguguacgaaaagaacggguacauauacuucuuuaaugggccgauccaauucgaguauucgauauggucgaauaggaucgucagggugaugccggccaacaguauccucuggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5728 - RNA, 1450 nt, Artificial Sequence
  mRNA product Design2 comprising derived and/or modified sequence from Homo sapiens__NP_001286.1__HsCCR1 (opt10)
ggggcgcugccuacggagguggcagccaucuccuucucggcaucaagcuuaccauggaaaccccgaacaccaccgaagauuacgacaccacaaccgaguucgacuacggcgacgccacccccugccaaaaagucaacgaacgcgccuucggcgcccaacuccucccaccccuuuacucccucgucuucgucaucggccucgucggcaauauccucguaguccucguccucguccaauacaaacgacucaaaaacaugaccuccaucuacuuacucaacuuagccaucuccgaccuccucuuccucuucacccuccccuucuggauagacuacaaacucaaagacgacugggucuucggcgacgccaugugcaaaauccucucgggcuucuacuacacaggacucuacuccgaaaucuucuucaucauccucuuaacuaucgaccgcuaccuagccaucguccacgccgucuucgcacuacgcgcccgcaccguaaccuucggcgucaucaccucaaucaucaucugggcccucgccauccucgccuccaugcccggccucuacuucucaaaaacccaaugggaguucacacaccacacaugcucacuccacuucccccacgaauccuuacgcgaauggaaacucuuccaagcccucaaacucaaccuauucggccuaguccucccacuacucgucaugaucaucugcuacacaggcaucaucaaaauacuccuccgccgccccaacgaaaagaaauccaaagcaguccgccucaucuuugucauaaugauaaucuucuuccuauucuggacccccuacaaccucaccauccucaucucaguauuccaagacuuccucuucacccaugaaugcgaacaaucacgccacuuagaccucgccguccaagucaccgaggucauugccuacacccacugcugcgucaacccaguaaucuacgccuucgucggcgaacgcuuccgcaaauaccuccgucaacuauuccaccgacgcgucgccguacaccucgucaaauggcuccccuuccuaucugucgaccgauuagaacgcgucuccuccacaagcccaagcaccggcgaacacgaacucuccgccggcuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5729 - RNA, 1018 nt, Artificial Sequence
  mRNA product Design2 comprising derived and/or modified sequence from Homo sapiens__NP_002598.4__HsPDGFA (opt10)
ggggcgcugccuacggagguggcagccaucuccuucucggcaucaagcuuaccaugcgaacauuagcaugcuuguuguuauuagguugcggguacuuagcgcacguguuagcagaggaggcagagaucccgcgugagguuaucgagcgcuuggcacgaucgcagauccacaguauccgagacuuacagcgguuguuggagaucgacucagucggcucggaggacucguuagacacgaguuuacgagcgcacggggugcacgccacgaagcacguaccggagaagcgcccguugccgauacgucgcaagcgaucgaucgaggaggcggugcccgcgguuugcaagacgcgaaccgucaucuacgagaucccacgaucgcagguagacccuaccucggcuaacuucuuaauauggccuccaugcguagaggucaagcguugcacggggugcugcaacacaucgucgguuaagugccagccgucgcgagugcaccaccguucgguaaagguggccaagguugaguacguacgaaagaagcccaagcuaaaggagguucagguucgauuggaggagcacuuagagugcgcuugcgccacgacgaguuugaaccccgacuaccgugaggaggacacggggcgaccgcgcgagucgggcaagaagcgaaagcgaaagcgguugaagccgacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5730 - RNA, 1108 nt, Artificial Sequence
  mRNA product Design2 comprising derived and/or modified sequence from Homo sapiens__NP_002599.1__HsPDGFB (opt10)
ggggcgcugccuacggagguggcagccaucuccuucucggcaucaagcuuaccaugaaccguugcugggcccuuuucuugucguuaugcugcuacuugcgcuuggugucggccgagggugauccgauaccggaggagcuguacgagaugcuaucugaccacaguauaaggucauucgacgacuugcagcgauuauuacacggggacccgggugaagaggacggggcggaguuagacuuaaacaugacgcgcucgcacucggguggggaguuggagucguuagcgcgggggcggcgaucguuagggucguugacgaucgcggagccugcgaugaucgcggagugcaagacgcguacggaggucuucgagauaucgcgacguuuaaucgaccgaaccaacgcaaacuucuuaguauggcccccuugcgucgagguacagaggugcaguggaugcugcaacaaccgaaacguccagugcaggccgacgcagguucaguugcguccgguacaaguccguaagaucgagaucguccguaagaagccgauauucaagaaggcuacgguaaccuuagaggaccaucucgccugcaagugcgagacugucgccgcggcgaggccgguaacucggucgcccggugggagucaggagcagcgugcgaagacgccgcagacgcgaguuaccauaaggaccguacgugugcgucguccgccgaaaggaaagcaccgaaaguucaagcacacgcacgacaagacugccuuaaaggagacguuaggugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5731 - RNA, 1420 nt, Artificial Sequence
  mRNA product Design2 comprising derived and/or modified sequence from Homo sapiens__NP_057289.1__HsPDGFC (opt10)
ggggcgcugccuacggagguggcagccaucuccuucucggcaucaagcuuaccaugucguuauucggcuuguuauuauugacgagugcguuagcagggcagcggcaagguacacaggcagagucgaaccucucgucgaaguuccaguucucgucgaacaaggagcagaacggugugcaggacccacagcacgagcguaucaucacgguuucgacaaacgggucgauacacucgccgcguuucccacacacguacccgcgaaacacuguguuagucuggcgucucguugccgucgaggagaacguuuggauccaguuaacuuucgacgagagguucgguuuagaggacccggaggacgacaucugcaaguacgacuucguugagguagaggagccuucagacgguacgaucuugggacgauggugcgggucggggaccguucccgggaagcagauaucgaaggggaaccagauacgaauccgauucgucucggacgaguacuucccgucggagccggguuucugcauacacuacaacauaguaaugccgcaguucacggaggccguuucgccgucugucuuaccgcccucggcguuaccguuagacuuacucaacaacgcgaucacggcguucucuacguuagaggacuuaauacguuacuuagagccggagcgauggcaauuagacuuggaggacuuguaccgccccaccuggcaguuacucgguaaggcauucguauucgggcgaaagagucgaguaguagacuuaaauuuauuaaccgaggagguucgacuauacucuugcacuccccgcaacuucucgguuucgauccgagaggagcuuaagcgcacggacacgauauucuggccggggugcuuauuggucaagaggugcggggguaacugcgcgugcugccuucacaacugcaacgagugccagugcgugccgucgaaggucacaaagaaguaccacgaggucuuacaacuucgccccaagacgggcgugcgagguuuacacaagagucuaacugacguagcgcucgagcaccacgaggagugcgacugcgucugcagggggucgaccggggggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5732 - RNA, 1477 nt, Artificial Sequence
  mRNA product Design2 comprising derived and/or modified sequence from Homo sapiens__NP_149126.1__HsPDGFD (opt10)
ggggcgcugccuacggagguggcagccaucuccuucucggcaucaagcuuaccaugcaccgacuaaucuucguauacaccuugauaugcgccaacuucugcuccugccgagacacgucggccacuccccagucggcuaguauaaaggcccuucguaacgcgaacuugcgucgggacgaccuuuacaggagggacgagacuauccaggucaagggcaacggauacguccaaucgccccgguuccccaacaguuacccgcggaacuuacuuuugaccuggcguuuacacucgcaggagaacacgaggauccaauuaguuuucgacaaccaguucggccucgaggaggccgagaacgacauaugccgauacgacuucguagagguagaggacaucagugagaccucgacgauaaucagggggcgguggugcggccacaaggagguacccccucgaaucaagagucgaaccaaccagaucaagauaaccuucaagucggacgacuacuucguagcaaagccgggguucaagauauacuacucgcucuuagaggacuuccagccggcggccgcgucggagacaaacugggagucgguaacgucgucgauaucgggugugucguacaacucacccucggucaccgacccgaccuugauagccgacgcguuagacaagaagaucgccgaguucgacacgguagaggacuuguugaaguacuucaacccggagucguggcaggaggacuuagagaacauguacuuagacacgccgagguacagggggcggucguaccacgaccgcaagucgaagguggacuuagaccgacuuaacgacgacgcgaagcgauacucgugcacaccucgaaacuacaguguaaacaucagggaggaguuaaaguuagccaacgucguauucuucccgcggugcuuauuaguucagcguugcgggggcaacugcgguugcgggacggugaacuggcgaucuugcacgugcaacucggguaagaccguaaagaaguaccacgagguccuucaguucgagcccgggcacauaaagcgucgcggccgugcgaagaccauggcgcucguggacauucaacucgaccaccacgagcguugcgacugcaucugcucgucgcgaccuccgcguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5733 - RNA, 1060 nt, Artificial Sequence
  mRNA product Design2 comprising derived and/or modified sequence from Homo sapiens__NP_003946.3__HsSOCS3 (opt10)
ggggcgcugccuacggagguggcagccaucuccuucucggcaucaagcuuaccaugguaacgcacucgaaguucccggcggcggguaugaguaggccguuagacacaucgcuucguuuaaagacauucucgucgaagagugaauaccagcucguugucaacgcgguccggaaguugcaagaaucagguuucuauuggucggcgguaacggggggggaggcaaauuuauuauugucggcggagccagcggggacauucuuaauccgugacucgucugaccagcggcacuuuuuuacauuaucagugaagacacaaucggguacgaagaaccuucgaauacagugcgagggcggaaguuucucguugcagagugacccgcgaucuacacagccggucccucgauucgacugcguauuaaaguugguucaccauuacaugcccccaccgggggcuccgaguuucccgucaccgccgacggagccgaguucggagguaccggagcagccaucggcgcagccuuuaccggguucgccgccucgacgcgcguacuacauauacucggggggugaaaagauuccacucguauuaucgaggccuuuaucgucgaacguagcgacacuccaacacuugugccgcaagaccguuaacggacauuuagacucguacgagaaggucacgcaacucccaggcccgaucagggaguucuuggaccaguacgacgcuccauuaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5734 - RNA, 865 nt, Artificial Sequence
  mRNA product Design2 comprising derived and/or modified sequence from Homo sapiens__NP_003227.1__HsTGFA (opt10)
ggggcgcugccuacggagguggcagccaucuccuucucggcaucaagcuuaccauggugccgagcgccgggcaauuggcguuauuugccuuagggaucguccucgccgccugucaagcgcucgaaaauucgaccagucccuuaucggccgaucccccggucgccgccgccgucgucagucacuucaacgauuguccggacagucauacccaauuuuguuuucacgggacgugucgcuuccucguccaagaagauaaaccggccugcgugugucacagcggcuaugucggggccaggugcgaacacgccgauuuguuagcggucgucgccgcgucgcaaaaaaaacaagcgauaacggcgcucgucgucgugaguauagucgcguuagccguguugauaauaaccugcgucuuaauccauuguugucaagugaggaagcauugcgaaugguguagagcguugauauguagacaugaaaaaccgucggcguuguuaaaagggcgcacggccuguugucauagcgagaccgucgugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5735 - RNA, 1555 nt, Artificial Sequence
  mRNA product Design2 comprising derived and/or modified sequence from Homo sapiens__NP_000651.3__HsTGFB1 (opt10)
ggggcgcugccuacggagguggcagccaucuccuucucggcaucaagcuuaccaugcccccgucugguuuacgauuauuacccuuauuguuacccuuauugugguuauuaguauugacccccgggcgaccggccgccggcuuaaguacgugcaagaccaucgacauggaguuaguaaagcggaagcgaauagaggcgauacgagggcagaucuuaucgaaguuacgauuagccaguccgcccucgcagggcgagguaccgcccgggcccuugcccgaggccguauuagcguuauacaacaguacccgagaccgaguagcgggugagucugcggagcccgagcccgagcccgaggccgacuacuacgccaaggagguaacacgaguauugaugguagagacccacaacgagaucuacgacaaguucaagcagaguacgcacucuaucuacauguucuucaacacgagugaguuacgagaggcgguucccgagcccguauuauuaagucgagcggaguuacgauuauugcgauuaaaguuaaagguagagcagcacguagaguuauaccagaaguacaguaacaacucuuggcgauacuuaucaaaccguuuauuagcgccgucugacagucccgagugguuaucuuucgacguaacggggguaguacgacagugguuaagucgugggggcgagauagagggguuccgauugucagcgcacugcaguugcgacucucgggacaacacguugcagguagacaucaacggcuucacgacggggcgacgaggcgacuuagccaccauacacggcaugaaccgacccuucuuauuauuaauggccacgcccuuagagcgugcgcagcacuuacagucuagucgacaccgacgagccuuagacaccaacuacugcuucaguucgaccgagaagaacugcugcguacgacaguuauacaucgacuuccgaaaggacuuaggguggaaguggauacacgagccgaagggcuaccacgcgaacuucugcuuagggcccugccccuacaucuggucguuagacacgcaguacaguaagguauuagccuuauacaaccagcacaaccccggcgccucggcggccccgugcugcguaccgcaggcguuggagcccuuacccauaguauacuacguaggccguaagccgaagguagagcaguuaaguaacaugauaguacgaucgugcaagugcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5736 - RNA, 1627 nt, Artificial Sequence
  mRNA product Design2 comprising derived and/or modified sequence from Homo sapiens__NP_003229.1__HsTGFB2 (opt10)
ggggcgcugccuacggagguggcagccaucuccuucucggcaucaagcuuaccaugcacuacugcguauuaucugcguucuugauauuacacuuaguuaccguggcauugaguuuauccacuugcaguacguuagacauggaccaguucaugcgaaagcgaauagaggcuauaaggggucagauuuugucgaagcucaaguuaacgucuccuccggaggacuaccccgagccggaagagguaccgccggagguaaucaguauauacaacucgacgcgagaccuuuuacaggaaaaggcaucgcgacgcgcagcggcgugcgagagggagcguucggacgaggaguacuacgcgaaggaaguauacaagaucgacaugccuccguucuucccgucggagaacgcgaucccaccuacguucuaucgaccguacuuccgcaucgucagguucgacguaagugcgauggagaagaacgccucuaacuuaguaaaggcggaguuucgaguauucagguuacagaacccgaaggcgcgaguucccgagcagaggaucgaguuauaccagaucuuaaagaguaaggaccuuacuucgccuacgcaacgauacauagacaguaagguaguaaagacgcgagccgagggagagugguuaucguucgacgucacggacgcgguccacgagugguuacaccacaaggaccgcaaccuuggcuucaagaucagucuccacugcccgugcugcacauucgucccuucgaacaacuauauaauaccgaacaagucggaggaguuagaggcucguuucgcgggaaucgacgggacgucgacguacacgucgggagaccagaagacgaucaagucgacgcgaaagaagaacucgggaaagacaccgcacuuguuauuaauguuguuaccgucguacagguuagagucgcagcagacgaaccgccgaaagaagcgagcgcuagacgcagcguacuguuuccgaaacguacaagacaacugcuguuuaaggcccuuauacaucgacuucaagcgcgacuuggguuggaaguggauccacgagccuaaggguuauaacgcaaacuucugcgcaggcgcgugccccuaccucuggucgucggacacccaacacagucgaguguuaucucuuuacaacacgaucaaccccgaggcgagugccucgccgugcugcgucucgcaggacuuggagccauuaacgaucuuguacuacaucgguaagacgccuaagaucgagcaguuaucgaacaugauagucaaaaguugcaagugcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5737 - RNA, 1621 nt, Artificial Sequence
  mRNA product Design2 comprising derived and/or modified sequence from Homo sapiens__NP_003230.1__HsTGFB3 (opt10)
ggggcgcugccuacggagguggcagccaucuccuucucggcaucaagcuuaccaugaagaugcacuugcagagggcguugguaguauuagcguuauugaacuucgcgacgguaucguuaaguuuaucgacaugcacgacguuggacuucggccacaucaagaagaagcgcguagaggcgauacggggucagauauuaaguaaguuacgcuugacgucgccgccggagccgacgguaaugacacacguaccguaccagguauuagcguuauacaacaguacgagggaguuguuagaggagaugcacggugagcgcgaggaggguugcacgcaggagaacacggagucggaguacuacgcgaaggagauacacaaguucgacaugauacaggguuuagcggagcacaacgaguuggcgguaugccccaaggggauaacgaguaaggucuucagguucaacguaucgaguguagagaagaaccgcacgaacuuauucagggcggaguuccgaguauuaagggucccgaacccgucgaguaagcgaaacgagcagaggauagaguuauuccagauauuacgccccgacgagcacauagcgaagcagcgguacauaggggguaagaacuuacccacgcgcgguacggcugagugguugucguucgacguaacagacacgguaagggagugguuauuacgcagggagaguaacuugggcuuagagauaucgauacacugcccuugccacacguuccagccgaacggggacauauuagagaacauacacgagguaauggagauaaaguucaaggguguagacaacgaggacgaccacgggcgaggggacuuggggagguuaaagaagcagaaggaccaccacaacccccacuuaauauugaugaugauaccgccgcaccgauuagacaaccccggucagggggggcagcgaaagaagagggcguuagacacgaacuacugcuuccgaaacuuggaggagaacugcugcguaaggccguuauacauagacuuccgccaggacuuaggguggaaguggguacacgagccgaaggguuacuacgcuaacuucugcagugguccgugccccuacuugaggucggcagacacaacgcacaguacgguauuagguuuauacaacacguugaacccggaggcgucggcuaguccgugcugcguaccgcaggacuuagagcccuuaacaauauuguacuacguagggagaacgccgaagguagagcaguuaucgaacaugguaguaaagucgugcaagugcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5738 - RNA, 1768 nt, Artificial Sequence
  mRNA product Design2 comprising derived and/or modified sequence from Homo sapiens__NP_001057.1__HsTNFRSF1B (opt10)
ggggcgcugccuacggagguggcagccaucuccuucucggcaucaagcuuaccauggccccgguggcggucugggcggcuuuagcgguagggcuugagcuuugggcggccgcgcacgcguuaccggcgcaggucgcguucacgcccuacgcucccgagccggguucaacgugcagguugcgcgaguacuacgaccaaacugcgcagaugugcugcucgaagugcuccccgggacagcacgcgaagguauucugcaccaaaacaucagacacggugugcgacucgugcgaggacucgacuuacacgcaauuauggaacugggugcccgagugccucucgugcggaucgcgaugcucgucagaccaaguagagacccaggccugcacgcgcgagcaaaaccggaucugcacgugccgcccgggcugguacugcgccuugucgaagcaggaggguugccgacucugcgcgccccuccgaaagugccggccggguuucgggguagcgcgaccugggacggagacgucggacguagucugcaagccgugcgcgcccggaacauucucuaacacgacaucgucuaccgacaucugccgcccgcaccagaucugcaacgucguugcaaucccggggaacgcgaguauggacgcgguaugcacaucgacgucgccgacgcgcucaauggcgccgggcgccgugcaccuuccgcagcccguaucgacgcggucgcagcacacccaaccgacgccggagccgucgaccgcgccgucgacuucguuccuuuuacccauggggcccucgccgcccgcggagggcucgaccggugacuucgcguugccgguaggguuaaucgugggcgucacggcguuaggguuguuaaucaucggcgucguaaacugcgugauaaugacgcagguaaagaagaagccgcugugcuugcagcgagaggcgaaggugccgcacuuaccggccgacaaggcccguggcacgcagggucccgagcagcagcacuuauuaauuaccgcgccgucgucgaguucgaguucguuggagucgagcgcaucggcccuagacaggcgagcccccacgcgaaaccagccgcaggcgccggguguggaggcgucuggggccggcgaggcccgugccucgaccggaucgucggacucgucgccgggcggacacgguacacagguaaacguaacuugcaucguuaacguaugcucgucgucggaccacucgagucagugcucgagucaggcgucgucgacgaugggggacacugacucgucgcccucagagaguccuaaggacgagcaggucccguucucgaaggaggagugcgccuuccguagucaacucgagacaccggagacgcuccucggaucaacggaggagaagccguuacccuuaggcguuccggacgcggggaugaagccgucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5739 - RNA, 895 nt, Artificial Sequence
  mRNA product Design2 comprising derived and/or modified sequence from Homo sapiens__NP_002623.2__HsPGF (opt10)
ggggcgcugccuacggagguggcagccaucuccuucucggcaucaagcuuaccaugcccguaaugcgcuuauuuccauguuucuugcaguuauuagcgggcuuggccuuacccgcaguaccaccgcaacaaugggcucucucggcagggaacgguaguucggaaguugaggucgucccguuccaggaggucuggggucgaaguuacugcagggcccuugagcgccucguggacguaguaagugaguauccgagugagguagagcauauguucucgccuaguugcguuucuuuauugagguguacagguugcugcggugacgagaacuuacacugcguacccguagagaccgccaacguaacuaugcaauuauugaagauucgaucgggagaccguccaucguacguagaguuaaccuuuagucagcauguccguugcgagugccguccgcuucgcgagaaaaugaagcccgagcgucgaaggccuaaagggcgcgggaagcggcgcagggagaaacagcgaccuacggacugucacuugugcggggacgcggucccgcgacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5740 - RNA, 1621 nt, Artificial Sequence
  mRNA product Design2 comprising derived and/or modified sequence from Homo sapiens__NP_001020537.2__HsVEGFA (opt10)
ggggcgcugccuacggagguggcagccaucuccuucucggcaucaagcuuaccaugaccgaccgccagaccgacacggcccccucgccguccuaccaccucuuacccggccggcgccggaccguggacgccgcggccucgcgcgggcagggccccgagcccgcccccgggggcggggucgagggcgugggcgcccgcgggguggccuuaaaguuauucguccagcucuuaggcugcucccgguucgggggcgcgguggugcgggccggggaggccgagcccucgggcgccgcgcgcuccgccucguccggccgggaggagccccagcccgaggagggggaggaggaggaggagaaggaggaggagcgcggcccgcaguggcgguuaggggcccgcaagcccggcucguggaccggcgaggccgccgucugcgcggacuccgcccccgccgcccgggccccgcaggcgcucgcccgcgccucggggcggggcgggcgcguggcccggcgcggcgccgaggaguccgggccgccccacucgcccucccggcgcggcucggcgucccgggccggccccgggcgcgccucggagaccaugaacuucuuauuauccugggugcacuggucgcucgccuuauuacucuacuuacaccacgccaaguggucccaggcggccccgauggccgagggcgggggccagaaccaccacgaggucgugaaguucauggacguguaccagcgcucguacugccaccccaucgagacguuagucgacaucuuccaggaguaccccgacgagaucgaguacaucuucaagcccucgugcgugccgcucaugcggugcgggggcugcugcaacgacgagggcuuagagugcgugcccaccgaggaguccaacaucaccaugcagaucaugcgcaucaagccccaccaggggcagcacaucggcgagaugucguucuuacagcacaacaagugcgagugccggcccaagaaggaccgcgcccggcaggagaagaaguccguccgcgggaagggcaaggggcagaagcggaagcgcaagaagucccgguacaagucguggucgguguacgugggcgcgcgcugcugccucaugccgugguccuuacccggcccccaccccugcgggccgugcucggagcggcgcaagcacuuauucguccaggacccgcagacgugcaagugcucgugcaagaacacggacucgcggugcaaggcgcgccagcucgaguuaaacgagcggacgugccgcugcgacaagccgcggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5741 - RNA, 1081 nt, Artificial Sequence
  mRNA product Design2 comprising derived and/or modified sequence from Homo sapiens__NP_001165094.1__HsVEGFA (opt10)
ggggcgcugccuacggagguggcagccaucuccuucucggcaucaagcuuaccaugaacuucuuauugucguggguccacuggaguuuagcguuauuguuauacuuacaccacgcgaaguggucgcaagcagcgccgauggcggagggggguggucaaaaccaccacgagguaguaaaguucauggacguguaccagaggucguacugccacccgauagagacguugguagacauauuccaagaguacccggacgagaucgaguacaucuucaagccgucgugcguaccguuaaugcgcugcggugguugcugcaacgacgaggguuuagagugcgucccuacggaggagaguaacaucacuaugcagauaaugaggauuaagccgcaucaagggcagcacauaggggagaugucguucuugcagcauaacaagugcgagugccgaccgaagaaggaccgagcgcgacaggagaagaagaguguaagggguaaagggaagggucaaaagcgcaagaggaaaaagagucgauacaagucguggucgguauacgucggggccaggugcugcuuaaugccguggucguuaccagggccgcacccgugcgggccgugcucggagcgcaggaagcacuuauucguacaggacccacagacgugcaagugcaguugcaagaacacggacucgcguugcaaggcacgacaguuagaguuaaacgagcgaacgugccggugcgacaagccucgaaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5742 - RNA, 1006 nt, Artificial Sequence
  mRNA product Design2 comprising derived and/or modified sequence from Homo sapiens__NP_003368.1__HsVEGFB (opt10)
ggggcgcugccuacggagguggcagccaucuccuucucggcaucaagcuuaccaugucgccguuauugaggagguuauuauuggcggccuuguuacaauuagcgccggcgcaagcgccggugagucaaccggacgcgccggggcaucaacgcaaggucgucagcuggaucgacgucuacaccagggccacgugucaaccgagagaagucgucgucccgcucaccgucgaauugauggggacggucgcgaagcaauuagucccgucgugugucaccguccaaaggugcgggggguguuguccggaugacggguuagaaugcgucccgaccggccaacaucaggugagaaugcaaauauugaugauaagauaucccucgucgcaauuaggcgaaaugaguuuagaggagcauucgcaaugcgagugucgcccgaagaagaaagauucggccgucaaaccggaucgcgccgcgaccccgcaucauaggccgcaaccgaggagcguccccgggugggauagcgcgccgggggccccgaguccggccgauauaacgcacccgaccccggcgccggggccgagcgcgcaugccgccccgucgacgacgucggcguuaacgccggggccggcggccgcggccgcggaugcggccgccaguagugucgcgaaagggggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5743 - RNA, 1642 nt, Artificial Sequence
  mRNA product Design2 comprising derived and/or modified sequence from Homo sapiens__NP_005420.1__HsVEGFC (opt10)
ggggcgcugccuacggagguggcagccaucuccuucucggcaucaagcuuaccaugcaccucuuaggguucuucagcgucgccugcuccuuacuggcggcggcccuccugcccgggccgcgcgaggccccggcggcggcggcggcguucgagagcggccuggaccucuccgacgccgagccggacgcgggggaggcgaccgccuacgccucgaaggacuuagaggagcagcugcgguccgucagcuccguggacgagcucaugaccgugcuguaccccgaguacuggaagauguacaagugccaguugcgcaagggcggguggcagcacaaccgggagcaggcgaaccucaacagccgcacggaggagaccaucaaguucgcggccgcccacuacaacaccgagauccucaaguccaucgacaacgaguggcggaagacccagugcaugccgcgcgaagucugcaucgacgucggcaaagaguucggcguggccacgaauacguuuuucaagccgcccugcgucaguguguaucggugcgggggcuguuguaacuccgaaggguuacaauguaugaauacgucgaccucguauuuaucgaaaacgcuguucgagaucaccguccccuugucccaggggccgaagcccgucaccauaucguucgcgaaccauaccucgugucgcuguaugagcaaguuagacguguaucgccaggugcacucgaucauccggcggaguuuacccgcgacguugccccaaugccaagccgccaauaaaacguguccgacgaacuauauguggaacaaccauauaugucgcuguuuagcccaagaggacuucauguucaguuccgacgccggggacgauagcaccgacggcuuucacgauauaugcggccccaauaaagaauuagacgaggaaacgugccaaugcgucugucgggcgggguugcgccccgcgucgugcggcccgcauaaggagcucgaucggaauagcugucaaugcgugugcaagaauaaguuguuuccgucgcagugcggggcgaaucgcgaguucgacgagaauacgugucaaugcgugugcaagcggacguguccgcgcaaccagccguugaaccccggcaagugcgcgugcgagugcaccgagucgccgcaaaagugucuccugaagggcaagaaauuucaucaucagaccuguucgugcuaucggcgccccugcaccaaucggcaaaaagccugcgaacccggguucagcuacuccgaggaggucugccgcugcgugcccagcuacuggaagcgcccgcagaugucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5744 - RNA, 1447 nt, Artificial Sequence
  mRNA product Design2 comprising derived and/or modified sequence from Homo sapiens__NP_004460.1__HsVEGFD (opt10)
ggggcgcugccuacggagguggcagccaucuccuucucggcaucaagcuuaccauguacagggaaugggucguagucaacgucuucaugauguuauacguacaauuaguacaagguucgucgaacgagcacgguccggucaagcguucgucgcaaucgacguuagagcguucggagcagcagauacgagcggcgucgucguuagaggaguugcuacggauaacgcacucggaggacuggaaguuauggcgaugucgauuacgcuuaaagucguucacaucgauggacucgaggucggcuucgcaccgcucgacgcgguucgccgcgacauucuacgacauagagacguuaaaggucaucgacgaggaguggcagcgcacgcagugcucgccgagggagacuugcgucgaggucgcgucagaauuggguaagucgacuaacacguuuuucaagccuccgugcguuaacgucuuccguugcggggguugcugcaacgaggagucguuaaucugcaugaacacaaguacgucauacaucucgaagcaauuauucgagaucucggucccauuaaccucggucccggaguuggugccgguaaagguagcgaaccacacggggugcaagugcuuaccgacggcuccgcgacacccguacaguauaauacgacggucgauacagauucccgaggaggaccgaugcagucacucgaagaagcuaugcccaaucgacaugcucugggacaguaacaagugcaagugcguauuacaggaggagaaccccuuggcggggacggaggaccacucgcacuugcaggagccggcguugugcggaccgcacaugauguucgacgaggaccggugcgagugcguaugcaagacuccgugcccgaaggacuugauucagcacccuaagaacugcucgugcuucgaaugcaaggagucguuagagacgugcugccagaagcacaaguuguuccacccggauacaugcaguugcgaggaccgaugcccguuccacacacgacccugcgcgucggguaagacggcuugcgcgaagcacugccgauucccuaaggagaagcgagcggcacaggguccgcacucucguaagaacccgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5745 - RNA, 1030 nt, Artificial Sequence
  mRNA product Design2 comprising derived and/or modified sequence from Homo sapiens__NP_002119.1__HsHMGB1 (opt10)
ggggcgcugccuacggagguggcagccaucuccuucucggcaucaagcuuaccauggguaaaggugacccgaaaaagccacgcgguaagaugaguucguaugcguucuucguccaaacgugccgagaggaacacaagaaaaagcacccggacgcgucgguaaacuucucggaguucucaaaaaagugcuccgaacgcuggaagacgaugucggcgaaagagaaagguaaauuugaagauauggcgaaagcggacaaggcgcgcuacgagagggagaugaagacauauauaccgccgaagggugagaccaagaaaaaguucaaggacccgaacgcgccgaagcggccgccgucugcguuuuuccuuuucuguucggaguaccgcccgaagauaaagggagagcacccgggccuuucgauaggcgacguagcgaaaaaguugggugaaauguggaauaacacggcggcggacgauaaacagccauaugaaaagaaagcagcgaagcucaaggaaaaguacgagaaagauaucgcggcauaucgagcaaaagguaaaccggacgcggcgaagaaagguguaguaaaagcagaaaagucgaagaaaaagaaagaggaagaggaagaugaagaggacgaggaagaugaagaggaagaggaagaugaagaggacgaggacgaggaagaggacgaugacgaugaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5746 - RNA, 977 nt, Artificial Sequence
  mRNA product Design3 comprising derived and/or modified sequence from Homo sapiens__NP_061986.1__HsFGF21 (opt10)
gggagagucccgcagucggcguccagcggcucugcuuguucgugugugugucguugcaggccuuauucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5747 - RNA, 1757 nt, Artificial Sequence
  mRNA product Design3 comprising derived and/or modified sequence from Homo sapiens__NP_002412.1__HsMMP1 (opt10)
gggagagucccgcagucggcguccagcggcucugcuuguucgugugugugucguugcaggccuuauucaagcuuaccaugcauucguucccgccguuauuauuauuauuauuuuggggggucgucagccauucguuuccggccaccuuggagacccaggaacaggacgucgaucucgugcaaaaguauuuagagaaguauuauaauuuaaaaaacgacggccgccaggucgagaaaagacgcaacucggggccggucgucgagaagcucaaacagaugcaagaguuuuucggcuuaaaggucaccggcaagccggacgccgagacguuaaaagucaugaaacaaccgcgcugcggggucccggacgucgcccaauucguguugaccgaaggcaauccgaggugggaacagacccacuuaacguaucgcaucgagaacuauaccccggaccucccgcgcgccgacgucgaucacgcgaucgaaaaggcguuucaguuguggucgaacgugaccccguuaaccuuuacgaaagugagcgaagggcaggccgauauaaugaucagcuucgugcgcggggaccacagagauaauagcccguucgacgggccgggggggaacuuggcccacgccuuccagccggggccggggaucgggggcgacgcccacuucgacgaggacgagcgcuggacgaauaacuuucgcgaauauaaucuccacagggucgccgcccacgaguuggggcacagcuugggguugagucacagcaccgacauaggcgcccucauguauccgucguauacguuuucgggggacguccaauuggcccaagacgauaucgacgggauacaggcgaucuacgggaggagucagaacccggugcaaccgauagggccgcagacgccgaaggccugcgauucgaaauugacguucgacgccaucaccaccaucagaggggaggucauguuuuucaaggaucgcuuuuauaugaggaccaacccguuuuaucccgaggucgaauugaacuuuaucagcgucuuuuggccgcaguuaccgaacggcuuggaggccgccuaugaguucgcggaucgcgacgaggugagauucuuuaagggcaacaaauauugggccguccaagggcaaaacgucuugcauggguauccgaaagauauauauucgaguuucggguuuccgcgcaccgucaaacacauagacgccgccuugagcgaagagaauaccgggaagacguauuuuuucgucgccaauaaguauuggcgcuacgacgaguacaagaggagcauggacccgggguacccgaagaugaucgcccacgauuucccggggaucgggcauaaggucgacgccgucuuuaugaaggacggguucuuuuacuuuuuccacgggacccgccaguauaaguucgacccgaagaccaaacgcauccucaccuugcaaaaggccaacucgugguuuaauugucgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5748 - RNA, 3413 nt, Artificial Sequence; identical to SEQ ID NO: 4739
  mRNA product Design3 comprising derived and/or modified sequence from Clostridium histolyticum__BAA34542.1__ColH (opt10)

SEQ ID NO: 5749 - RNA, 2534 nt, Artificial Sequence
  mRNA product Design3 comprising derived and/or modified sequence from Homo sapiens__NP_000592.3__HsHGF (opt10)
gggagagucccgcagucggcguccagcggcucugcuuguucgugugugugucguugcaggccuuauucaagcuuaccaugugggucacgaaguuguuaccggcguuauuauuacaacacguguuguuacacuuguuguuauugccgauagcgauaccguaugccgaagggcagcgcaagcgccgcaauaccauccacgaguuuaagaagagugccaaaaccacguugauaaagaucgacccggccuuaaaaaucaagacgaaaaaggucaacaccgccgaucagugcgccaaccgcugcacccgcaacaagggguugccguuuaccuguaaagccuucgucuucgacaaggcccgcaagcaauguuugugguuuccguuuaacucgaugagcucgggggucaagaaggaguucgggcacgaguucgauuuguaugagaauaaggauuauauccgcaauuguauaaucgggaaagggaggucguauaaagggaccgucagcauaaccaaaucggggauaaaaugccaaccguggucgaguaugaucccgcaugagcauucguuccucccgagcucguacagagggaaggauuugcaagagaauuauugcaggaacccgaggggcgaggagggcgggccguggugcuuuaccucgaacccggaagucagguaugaggugugcgauaucccgcaaugcagcgaggucgaguguaugacguguaacggcgaaucguacaggggguugauggaccacaccgagagcgggaaaaucugccaaaggugggaccaccaaaccccgcauagacauaaauuucucccggagcgcuauccggauaaaggguucgacgacaacuacuguaggaacccggacgggcaaccccgcccgugguguuauaccuuggauccgcauacgaggugggaauauugcgccaucaaaaccugugccgauaacaccaugaacgauaccgacgucccgcucgagaccaccgaguguauacaggggcagggggagggguaucgcgggaccgugaacacgaucuggaacgggaucccgugccaaaggugggacagccaauauccgcaugaacacgauaugaccccggagaacuuuaaauguaaagauuugagggagaacuauuguaggaacccggacggcagcgagagcccguggugcuucacgaccgacccgaauauaagggucggguauuguagucagaucccgaauugcgacaugagccacgggcaagacugcuauaggggcaacgggaaaaacuacauggggaaucucagucagacccgcagcggguugaccugcagcaugugggauaaaaauauggaggaucuccacaggcacauauuuugggagccggacgccucgaaauuaaacgaaaacuauuguaggaacccggacgacgacgcccacgggccgugguguuauaccgggaacccguugaucccgugggacuauuguccgaucaguaggugcgagggggacacgaccccgaccaucgugaaccucgaucacccggucaucagcugcgcgaagaccaagcagcucagggucgucaacggcaucccgaccaggaccaauaucggguggauggucucgcuccgcuaucgcaacaagcacauauguggggggagccucaucaaagaaucgugggucuugaccgccaggcaaugcuuuccgagcagggaucucaaggacuacgaggccugguuggggauccacgacgugcaugggcgcggggacgaaaaguguaagcaagucuugaacgucagucaauuagucuacgggccggaggggagcgacuuaguccucaugaaauuggcgcgcccggccguguuagacgacuucgucucgaccaucgaccucccgaauuacggguguaccaucccggagaaaacgucguguucggucuauggguggggguauaccgggcucauaaauuacgacggguugcucagggucgcccacuuguauaucauggggaacgaaaaguguucgcaacaccacaggggcaaagucaccuuaaacgaaagcgagaucugcgccggcgccgagaaaaucgggagcgggccgugcgaaggcgacuauggggggccguuggucugcgaacagcacaaaaugcgcauggucuugggggugaucgucccggggagggggugcgcgaucccgaacaggccggggaucuucgugagggucgccuacuacgccaaguggauccauaagaucauccucaccuauaaagucccgcaaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5750 - RNA, 923 nt, Artificial Sequence
  mRNA product Design3 comprising derived and/or modified sequence from Homo sapiens__NP_001133.1__HsAMELX (opt10)
gggagagucccgcagucggcguccagcggcucugcuuguucgugugugugucguugcaggccuuauucaagcuuaccauggguacguggauacucuucgcgugcuuguuaggugcggcguucgcgaugccguuaccgccgcacccaggccacccgggauacaucaacuucucguacgaggucuuaacgccgcucaagugguaccagaguauccgaccuccuuaccccucguacggauacgagccgaugggggguugguuacaccaccagauaauaccaguauugagucagcaacacccgccaacgcacacuuuacagccgcaccaccacauccccguaguccccgcgcagcaaccggucaucccgcaacagccgaugaugccgguacccgggcagcacucgaugacaccuauccagcaccaccaaccgaacuugccgccgccggcgcagcaacccuaccagccacagccgguccagccucaaccccaccagccuaugcagccucagccgccgguacacccgaugcagccguuaccaccgcagcccccguuaccgcccauguucccgaugcaaccccucccgccgauguuaccggacuuaacguuagaggcguggccuucgacggacaagacgaagcgcgaggagguugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5751 - RNA, 482 nt, Artificial Sequence
  mRNA product Design3 comprising derived and/or modified sequence from Homo sapiens__NP_001133.1__HsAMELX-TRAP (opt10)
gggagagucccgcagucggcguccagcggcucugcuuguucgugugugugucguugcaggccuuauucaagcuuaccaugccguugccgccgcauccgggucacccgggguauauaaacuucucguaugaggucuugacgccgcucaagugguaccaaucgauucgcccgccuuacccgaguuauggguacgagccgauggggggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5752 - RNA, 926 nt, Artificial Sequence
  mRNA product Design3 comprising derived and/or modified sequence from Homo sapiens__NP_001134.1__HsAMELY (opt10)
gggagagucccgcagucggcguccagcggcucugcuuguucgugugugugucguugcaggccuuauucaagcuuaccauggguacauggauauuauucgcgugcuuggucggugcugcauucgcaaugccauuaccuccccacccaggccacccgggguacauuaauuucucguacgagguauuaacgccgcuuaaaugguaccagaguaugaucaggccgccguacucgucguacggauacgaacccaugggggguugguuacaucaccagauaauaccgguagucucgcagcagcacccguuaacgcacacguugcaaucgcaccaccacauaccgguaguaccggcgcagcaaccucgcguuaggcagcaggcguuaaugccgguaccggggcagcagucgaugacaccgacccagcaccaccagccgaacuuaccauuacccgcucaacagccauuccagccgcaacccguccagccgcaaccccaucagccgaugcaaccgcaaccgccgguacagccgaugcagccguuguuaccgcagccgccguugccacccauguucccguuacgcccuuuaccuccgaucuuaccggacuuacacuuagaggcauggccggcgacggacaagacgaagcaggaggagguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5753 - RNA, 485 nt, Artificial Sequence
  mRNA product Design3 comprising derived and/or modified sequence from Homo sapiens__NP_001134.1__HsAMELY-TRAP (opt10)
gggagagucccgcagucggcguccagcggcucugcuuguucgugugugugucguugcaggccuuauucaagcuuaccaugccguugccgccgcacccgggccauccgggguacauaaauuuuucguacgaagucuugacgccgcucaaaugguaucaaucgaugauccgcccgccguauagcaguuacggguaugaaccgauggggggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5754 - RNA, 3308 nt, Artificial Sequence
  mRNA product Design3 comprising derived and/or modified sequence from Homo sapiens__NP_006120.1__HsBMP1 (opt10)
gggagagucccgcagucggcguccagcggcucugcuuguucgugugugugucguugcaggccuuauucaagcuuaccaugcccggagucgcgcgauugccauugcucuuagguuuguuauuauuaccacgcccggggaggccccucgacuuagcggacuacacguacgacuuggcagaggaggacgacucugaaccuuuaaacuacaaggacccgugcaaggcugccgcguucuuaggggacauagcguuggacgaggaggacuuacgcgcuuuccaaguccagcaggcgguugacuuaaggcgccacacggcgcggaaaaguucgaucaaggcggcgguacccgggaacacaaguacgccgucgugccaaaguacaaacggacaaccacagcgcggggcgugcggacgguggcgagggaggucgaggaguaggcgagcagccaccucgcgucccgagcggguauggccggacgguguaauuccauucguaauagguggcaacuucacgggaagucagcgggcgguauuccgccaggcgaugcgacacugggagaaacacacaugcguuacguucuuggagcgaaccgacgaggacucguacauaguauuuacguaccguccaugcggcugcugcaguuacguagggcgaagggguggcgguccgcaagcgaucucgauagguaagaacugcgacaaguucgguaucguaguucacgaguuaggucacguuguagguuucuggcacgagcacacgcgaccugaccgcgacaggcacgucaguauaguccgcgagaacauacagccgggacaggaguacaacuucuuaaaaauggagccgcaagagguugagucguugggugagacguacgacuucgacucgauaaugcacuacgcgcgaaacacguucucgcgcgggauuuucuuagacacaauaguuccgaaauacgagguaaacggcgucaagccgccgauaggccagcggacucgcuugucgaagggugacauagcgcaggcgcggaaguuguauaagugcccggcgugcggugagacauuacaggacucgacgggaaacuuuaguucgcccgaguacccuaacggcuacucggcgcacaugcacugcgucuggcgaauaucgguaacuccgggggagaagauuauuuuaaauuucacuucauuggauuuauauaggucgcgauuauguugguacgacuacguagaaguaagggacggguuuuggcguaaggccccuuugcgugggcgauucugcggaucgaaguuaccggagccgauaguaaguacggacucgcguuuauggguagaguuccgaaguucgaguaacuggguagguaaggguuucuucgccguuuacgaggcaauaugcgguggggacguaaagaaggacuacggucauauacagucuccgaauuacccggacgacuacaggccuaguaagguauguauauggcgcauccaagucucggagggauuccauguuggguugacguuucagaguuucgagauagagaggcacgacucgugcgcguacgauuacuuagagguaagggacggacauucggagucgaguacuuuaauaggacgauacugcgguuacgagaagccggacgacauaaagucgacuucgucgcgauugugguuaaaguucguuucggacggaaguauaaacaaggcagguuucgcgguuaacuucuuuaaggagguagacgagugcucgcgaccgaaccgaggcgguugcgagcaacgaugcuuaaacacguugggaucuuacaaaugcucuugcgacccggguuacgaguuggcgccggauaagaggcgaugcgaggcggcaugcggggguuucuuaacaaaguugaacgguucgauaacaucgcccggguggccgaaggaguacccgccgaacaagaacugcauauggcaauuagucgcgccgacacaauaccggauuucguuacaguucgacuucuucgagacggaggguaacgacgucuguaaguacgacuucgucgagguccgaucggguuugacugcggacucaaaguuacacgguaaguucugcggcucggagaagccggagguaauuacaucgcaguacaacaacaugcgagucgaguucaagucggacaacacgguaaguaagaagggguucaaggcacacuucuucucggauaaggacgaguguucgaaagacaacggggguugccaacaggacugcguaaacaccuucgguucguacgagugucagugccgaucggguuucguauuacacgacaacaagcacgacugcaaggaggcaggaugcgaccauaaggucacgucgacuucggggacgauaacgucgccgaacuggccggacaaguacccgucgaagaaggagugcaccugggcgaucucgucaacuccgggucaucgaguuaaguugacguucauggagauggauauugagucgcagcccgagugcgcguacgaccacuuagagguauucgacgggcgugacgcgaaagcaccgguauuaggaagguucugcgguucgaagaaacccgaaccgguuuuggcgacgggaagucguauguucuuacgguucuacucggacaauaguguacaacguaagggguuccaagcaucgcaugcgacggagugcgguggucagguccgagcggacguuaaaacgaaagacuuauacucgcacgcgcaguucggggacaauaacuacccgggcgggguugacugcgaguggguuauagucgcagaggagggguacgguguagaguuaguauuccagacuuucgaggucgaggaggagacggacugcgguuacgacuacauggaguuauucgacgguuacgacucgacggcgccacgauuagguagguacugcgggucgggaccgccggaggagguauacucagccggugacaguguauuagucaaguuucacucugacgacacgauaacgaagaagggcuuccacuuacguuacacgaguacgaaguuccaggacacguuacacucucgaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5755 - RNA, 1538 nt, Artificial Sequence
  mRNA product Design3 comprising derived and/or modified sequence from Homo sapiens__NP_001191.1__HsBMP2 (opt10)
gggagagucccgcagucggcguccagcggcucugcuuguucgugugugugucguugcaggccuuauucaagcuuaccauggucgcgggcacgagguguuuguuggcacucuuauugccgcaaguauuguuagggggggccgcgggguugguccccgaguuagggaggcgcaaguucgccgccgcaagcagcgggaggccgagcagucagccgagcgacgagguauuaucggaguucgagcucagauuauugucgauguucggguuaaaacaacgcccgacgccgucgcgcgacgcggucgucccgccguauauguuggacuuauauaggcgccacagcgggcagcccgggagcccggcgccggaccacagacucgagcgcgcggcgucgagggcgaacacggucaggucguuccaccaugaagaaagccucgaagaauugccggaaacaucgggcaaaacgacgagacgcuucuucuuuaaucucucgagcauaccgaccgaggaguuuauaacgagcgccgaguugcaagucuucagggaacagaugcaagaugcgcucgggaacaauucgucguuccaucacaggauaaauauauaugaaauaauuaaaccggccacggcgaacagcaaauucccggucacgcgcuugcucgacacgcgccucgucaaucagaaugcgucgcgcugggaaucguuugauguaacgccggcggucaugagauggaccgcccaggggcacgcgaaccauggguucgucgucgaagucgcgcaccucgaggagaaacaagggguaaguaagcgccauguccgcauuucgcgcagccuccaccaagaugaacacucguggagccagauucgcccgcucuuggucacguuugggcaugaugggaaaggccauccguugcacaaacgcgaaaaaaggcaagcgaaacacaaacaaagaaaaagguugaagaguucguguaagcgccacccgcucuacgucgacuucucggacgucgguuggaaugacuggauagucgccccgccuggcuaucacgcguuuuauugccacggggaaugcccguuuccguuagccgaucauuuaaacaguacgaaucaugcgauaguccagacacucguaaacagcgucaacagcaagauaccgaaagcgugcuguguacccacggaauugucggcgauaagcauguuauauuuggacgagaaugaaaaggucguccucaaaaauuaucaggacauggucgucgagggguguggcuguaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5756 - RNA, 1574 nt, Artificial Sequence
  mRNA product Design3 comprising derived and/or modified sequence from Homo sapiens__NP_001193.2__HsBMP4 (opt10)
gggagagucccgcagucggcguccagcggcucugcuuguucgugugugugucguugcaggccuuauucaagcuuaccaugauaccgggaaacaggauguuaaugguaguauuguugugccagguauuauuggguggugccucgcacgcgaguuugaucccggagaccgguaagaagaagguagcggagauccagggccacgcggggggccgacguagcggucagucgcacgaguuauugcgagacuucgaggccacgcucuuacagauguucggucuucgccgaaggccgcagccgucuaagucggccgucauacccgacuacaugcgagacuuauaccgauuacagucgggcgaggaggaggaggagcagauccacaguacgggguuagaguacccggagcguccggccucgcgagcgaacacgguccgcucguuccaccacgaggagcacuuggagaacauaccgggcaccucggagaacagugcguucagauucuuauucaacuuaucgaguaucccagagaacgaggugauaucuagugcggaguugcgcuuauuccgugagcagguugaccaagggccggacugggagcgcggcuuccaccgaaucaacaucuacgaggugaugaagccgccggcggagguaguacccggucacuuaaucacucgucucuuagacacgcgauuaguacaccacaacguaacgaggugggagacguucgacgucaguccggcgguauugagguggacgcgcgagaagcagcccaacuacggauuagcgaucgaggucacgcaccuacaccagacccguacgcaccagggccagcacguccgaauaucgcgaucgcuaccgcagggaucggguaacugggcgcaauuaagaccguuguuaguaacguucggccacgacgggcgaggccacgcuuuaacgcgucgacgacgugcgaagcgcucgccgaagcaccacucgcagcgagcgcgaaagaagaacaagaacugccgacgucacagucuuuacguugacuucucggacgucggauggaacgacuggauaguugcgccgccgggcuaccaggcguucuacugccacggggacugcccguucccguuagccgaccacuuaaacaguaccaaccacgccaucguccagacgcuuguaaacucgguaaacaguucaauacccaaggcgugcugcguacccacggaguuaagugcgaucucgauguuauacuuggacgaguacgacaagguuguuuuaaagaacuaccaggagaugguuguggagggcugcggaugccguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5757 - RNA, 1889 nt, Artificial Sequence
  mRNA product Design3 comprising derived and/or modified sequence from Homo sapiens__NP_001709.1__HsBMP6 (opt10)
gggagagucccgcagucggcguccagcggcucugcuuguucgugugugugucguugcaggccuuauucaagcuuaccaugcccggcuuaggcagacgcgcccaaugguuauguuggugguggggcuuauuauguucguguuguggcccgccccccuuaagacccccgcucccggccgcggccgcggcggcggcgggcggccaauuauuaggcgaugggggcucgccggggaggaccgaacaacccccccccagcccccaaaguaguagcggguuuuuauauagaagauugaaaacccaagaaaaaagagaaaugcaaaaagaaauacucagcgucuuaggcuugccccauagaccgagaccguuacauggguugcagcaaccccaaccgcccgccuugagacaacaagaagaacaacaacaacaacaacaauuaccgaggggggaaccgccgccgggcagguuaaaaagugccccguuguuuauguuagacuuauauaaugcguuaagugcggauaaugaugaagauggcgccagcgaaggcgaacgccaacaaaguuggccgcaugaggccgcgucgagcagucaaaggagacaacccccgcccggggcggcccaucccuugaauaggaaaucguuguuagcgccggggagcgggucggggggggccaguccguuaacgucggcccaagauucggcguuuuugaaugaugccgauauggugaugucguucgucaauuuagucgaauaugauaaagaauuuaguccgaggcaaaggcaucauaaggaauuuaaauuuaaucucagucaaaucccggaaggggaagucgucaccgccgccgaguuuaggauauauaaagauugcgucaugggcucguucaagaaucagaccuucuugauaucgaucuaccaggugcuccaagaacaccaacaucgcgauagcgauuuauuccuccucgauacgagggucgucugggcgagcgaggaggggugguuagaguucgauauaaccgcgaccucgaacuuaugggucgucaccccgcaacacaauaugggcuugcaauuaucggucgucacccgcgacggggugcaugugcauccgagggcggccggguuagucgggcgcgaugggccguaugauaaacaaccguuuauggucgccuuuuuuaaggucucggaaguccaugucaggacgacgcgcagcgcgaguucgagaaggaggcagcaaucgaggaacaggagcacgcaaagucaagaugucgccagagugaguucggccagcgacuauaauucgucggagcucaagaccgcgugucgcaaacacgaauuauacgucucguuucaggauuuaggguggcaagauuggauaaucgccccgaaaggguacgccgcgaacuauugcgacggggaguguaguuuuccguugaaugcccauaugaacgccacgaaucaugccaucguccaaacgcucguccauuugaugaauccggaauacgugccgaagcccuguugcgccccgaccaaauugaacgcgauaagcgucuuguauuucgacgauaauaguaacgugaucuuaaagaaguaucgcaacauggucguccgcgccugcgggugucauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5758 - RNA, 1643 nt, Artificial Sequence
  mRNA product Design3 comprising derived and/or modified sequence from Homo sapiens__NP_001710.1__HsBMP7 (opt10)
gggagagucccgcagucggcguccagcggcucugcuuguucgugugugugucguugcaggccuuauucaagcuuaccaugcacguaagaucguuacgagcggcggcuccgcacaguuucguagcguugugggccccguuauucuuauugcgaucggcguuagcggacuucaguuuagacaacgagguacacucgaguuucauacaccgaagauugcgcucgcaggagaggcgcgagaugcagcgagagauauuaaguauauuaggguugccgcaccgacccaggccccacuugcaggggaagcacaacucggcuccaauguucauguuagacuuauacaacgcgauggcgguagaggagggggggggucccgggggucagggcuucaguuaccccuacaaggcgguauucucuacgcaggguccgccguuagcgaguuuacaggacucgcacuucuugacggacgcggacaugguaaugaguuucguaaacuuaguagagcacgacaaggaguucuuccacccgcgauaccaccacagggaguuccgauucgacuuaucgaagauacccgagggggaggcgguaacggcggcggaguucaggauauacaaggacuacauccgagagagauucgacaacgagacguuccgaauaaguguauaccagguauugcaggagcacuuagguagggagucggacuuauucuuguuagacagucgcacguuaugggcgucggaggaggguugguuggucuucgacauaacggcgacgaguaaccacugggucguaaaccccaggcacaacuuagguuuacaguugucgguagagacauuagacggucagucgauaaacccgaaguuagccggguugaucggucgacacggcccgcagaacaagcagccguucaugguagccuucuucaaggcgacggagguacacuucaggaguauaaggucgacggguaguaagcagcgaucgcagaacaggaguaagacaccaaagaaccaggaggcguuaagaauggcgaacguagcugagaacucgaguucggaccagaggcaggcgugcaagaagcacgaguuauacguaaguuuccgcgacuugggguggcaggacuggauaauagcgccggagggguacgcagcguacuacugcgagggugagugcgcguuccccuuaaacucguacaugaacgcgacgaaccacgcgauaguacagacguuaguacacuucaucaacccggagacaguaccgaagccgugcugcgcgccgacgcaguugaacgcgauaaguguauuauacuucgacgacucgaguaacguaaucuuaaagaaguacaggaacaugguaguacgagcgugcgguugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5759 - RNA, 647 nt, Artificial Sequence
  mRNA product Design3 comprising derived and/or modified sequence from Homo sapiens__NP_006264.2__HsCCL7 (opt10)
gggagagucccgcagucggcguccagcggcucugcuuguucgugugugugucguugcaggccuuauucaagcuuaccaugaaggcgucggccgcguuacuaugcuuauuacuuaccgccgcggcguucucgccgcagggcuuagcgcaaccgguagguauaaacaccaguacgacaugcugcuacagguucauaaacaagaagaucccgaagcagcgauuagagaguuaccgucguacgacgagcucucacugcccgcgugaggcggucauauucaaaacgaaguuagacaaggagauaugcgcagaccccacccagaaguggguacaggacuucaugaagcacuuagacaagaagacgcagacgccuaaguugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5760 - RNA, 3971 nt, Artificial Sequence
  mRNA product Design3 comprising derived and/or modified sequence from Homo sapiens__NP_001954.2__HsEGF (opt10)
gggagagucccgcagucggcguccagcggcucugcuuguucgugugugugucguugcaggccuuauucaagcuuaccauguuauugaccuugauaaucuuacucccggucgucagcaaguucucguucgucucguugagcgccccccaacauuggucgugcccggaggggaccuuggccgggaacggcaacaguaccugcgucgggccggccccguuucucaucuuuagucacgggaacucgauauuccgcaucgauaccgaggggacgaacuacgaacagcucgucgucgacgccggggugagcgucauaauggacuuccacuacaacgaaaagcgcauauacugggucgaccucgagcgccaguugcuccagcgcgucuucuuaaacggcagccgccaggaacgcgucugcaacaucgaaaagaacgucagcgggauggccaucaacuggaucaacgaggaggucaucuggagcaaccagcaagaggggauaaucaccgucaccgacaugaaggggaacaacagucauaucuugcucucggcccucaaguacccggccaacgucgccgucgacccggucgagcgcuucaucuucuggagcagcgaagucgccgggucguuguaccgcgccgacuuggacggggucggggucaaagccuuacucgaaaccagcgaaaagaucaccgccgucagccucgacgucuuggacaaaagauuauucuggauccaauauaaucgcgaggggucgaacagcuugaucuguaguugcgacuacgacggggggagcgugcauaucucgaagcacccgacccaacacaaccucuucgccaugaguuuguucggggauaggauauuuuacagcaccuggaagaugaaaaccaucuggaucgcgaauaagcauaccgggaaagauaugguccgcaucaauuugcacagcagcuucgucccguugggggaguuaaaggucguccacccguuggcccagccgaaagccgaggacgauaccugggaaccggaacaaaaguuguguaagcuccgcaaggggaauuguucgucgaccgucugcggccaggauuugcaaagccaucucuguaugugcgccgaaggguaugcguugucgagggauagaaaauauugcgaggacgucaacgagugcgccuucuggaaccacgggugcaccuugggcugcaagaauacgccggggaguuacuauuguaccuguccggucggguucgucuuauugccggacggcaagaggugccaccaguuggucaguugcccgaggaacgucagcgaguguucgcacgauugcgucuuaaccagcgaggggccgcucugcuuuugcccggaggggagcgucuuggaacgcgacggcaagaccugcucggggugcaguagcccggacaacggggggugcucgcaauugugugucccguugucgccggucaguugggagugcgacuguuucccgggcuacgauuugcaguuagacgagaagucgugcgccgccagcgggccgcagccguuccucuuauucgcgaacagccaggacaucaggcauaugcacuucgacgggaccgauuacgggaccuuauugucgcaacaaauggggauggucuacgcguuggaccacgauccggucgagaacaaaaucuauuucgcgcacaccgcguuaaaauggaucgaacgcgccaacauggacgggagucaaagggagcgcuugaucgaagagggggucgacgucccggagggguuggccgucgauuggaucgggaggcgcuuuuacuggaccgaucgcggcaagagcuuaaucgggcgcucggaccucaacggcaagaggaguaagaucauaaccaaagaaaauauaagccagccgagggggaucgccguccacccgauggcgaaacgccucuuuuggaccgacaccggcaucaacccgaggaucgagucgagcaguuugcagggguuggggagguuagucaucgcgucgagcgacuugauauggccgucggggaucaccaucgauuuucucaccgauaaacucuauuggugugacgcgaaacaaagcgucaucgagauggcgaacuuagacgggagcaagaggaggcgcuugacgcaaaacgacgucgggcauccguucgccgucgccgucuucgaagacuacgucugguuuagcgacugggccaugccgagcgucaugcgcgucaauaaacgcaccgggaaggaccgcgucagguugcaggggucgauguuaaaaccgagcagcuuagucgucguccacccgcucgccaagccgggggccgacccgugucucuaccagaauggggggugcgagcacaucuguaagaaacgcuuggggaccgccuggugcagcugcagggagggguucaugaaggcgagcgacggcaagaccugcuuagccuuagacgggcaccaauuacucgccgggggggaggucgacuugaaaaaucaggucaccccgcucgauauacucaguaaaacccgcgucagcgaggacaauaucaccgagagccagcauauguuggucgccgagauaauggucagcgaccaggacgauugcgccccggucggguguucgauguacgccagaugcaucagcgaaggggaagacgcgaccugccaaugccucaagggguucgccggcgacgggaaguugugcagcgacaucgacgagugcgaaaugggggugccggucuguccgccggcgaguaguaaauguauaaauacggaggggggguacguguguagauguagcgagggguaucagggggacggcauccauugcuuggacaucgacgaaugucaguuaggcgaacauucgugcggggaaaacgcgucguguaccaacaccgaagggggguacacguguaugugcgccgggagguuaagcgagccgggguuaaucuguccggauagcaccccgccgccgcauuugcgcgaggacgaucaucauuacaguguccgcaacucggauagcgagugcccguuaagucaugacggcuauuguuugcacgacggggucuguauguacaucgaggcccucgauaaauacgccuguaauugcgucgucggguauauaggcgaaaggugccaauauagggauuuaaaauggugggaguuaaggcaugccgggcauggccaacaacaaaaagugauagucgucgccgugugugucgucgucuuggugauguuauuguuguuaucguuauggggcgcgcauuauuaucgcacccaaaaauuauugagcaagaauccgaaaaacccguacgaagaaagcucgcgcgacguccgcucgaggcgcccggccgauaccgaagacggcaugaguagcuguccgcagccgugguucgucgucaucaaggagcaucaggauuugaaaaacggcgggcagccggucgccggggaagacgggcaagccgccgacggcagcaugcagccgaccagcuggcgccaagaaccgcaacucugcgggauggggaccgaacagggguguuggaucccggucaguucggacaaagggaguugcccgcaagucauggaaaggucguuccacaugccgaguuacggcacccaaacguuggagggcgggguggaaaaaccgcacagcuuguugagcgccaauccgcucuggcagcagcgcgcguuagauccgccgcaucagauggaauuaacccaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5761 - RNA, 857 nt, Artificial Sequence
  mRNA product Design3 comprising derived and/or modified sequence from Homo sapiens__NP_001423.1__HsEREG (opt10)
gggagagucccgcagucggcguccagcggcucugcuuguucgugugugugucguugcaggccuuauucaagcuuaccaugacggccggccgccgcauggaaauguugugcgcggggcgcgugccggccuuauuauuguguuuaggguuucacuuguugcaagccguguugucgaccaccgucaucccgagcugcauaccgggggaaaguucggacaauuguaccgcccucguccaaaccgaggauaacccgagggucgcccaggucagcaucaccaaaugcucgagcgauaugaacggguacugccuccacgggcaauguauauacuuagucgauaugucgcagaauuauugucgcugcgaggucggguacaccggggugaggugcgagcauuuuuuccucacggugcaucagccgcucucgaaggaguacgucgcccucacggucaucuugaucauccucuucuugauaaccgugguggggaguaccuacuacuuuugucgcugguaucgcaacaggaagucgaaggagccgaaaaaagaguacgaacgcgucacgagcggcgacccggaacucccccaggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5762 - RNA, 815 nt, Artificial Sequence
  mRNA product Design3 comprising derived and/or modified sequence from Homo sapiens__NP_000791.1__HsFGF1 (opt10)
gggagagucccgcagucggcguccagcggcucugcuuguucgugugugugucguugcaggccuuauucaagcuuaccauggcggagggugagauaacgacguucacugcguuaacggagaaguucaacuuaccgccggguaacuacaagaagcccaaguuguuauacugcucgaacggggggcacuucuuacgaauauuaccagacggcacgguagacgguacccgagaccggucggaccagcacauccaguuacaauuaucggcggagaguguuggcgagguauacaucaagucgacugagacagggcaguacuuggcgauggacacggacggguuauuguacgggagucaaacgccgaacgaggagugcuuauucuuagagcgcuuggaggagaaccacuacaacacguacaucucgaagaagcacgcggagaagaacugguucguaggguuaaagaagaacgguaguugcaagcgggggccacgcacgcacuacggucagaaggcgaucuuauucuugccguuaccaguaucgagugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5763 - RNA, 1214 nt, Artificial Sequence
  mRNA product Design3 comprising derived and/or modified sequence from Homo sapiens__NP_001997.5__HsFGF2 (opt10)
gggagagucccgcagucggcguccagcggcucugcuuguucgugugugugucguugcaggccuuauucaagcuuaccauggugggcgucgggggcggggacguggaggacgugaccccgcgcccgggcgggugccagaucucgggccggggcgcccgcgggugcaacggcauccccggggccgcggccugggaggccgcccugccccggcgccggccccgccggcacccguccgucaacccccgcucgcgggccgcgggcucgccccgcacccgggggcgccggacggaggagcgccccuccggcucccggcucggcgaccgcgggcggggccgcgcccugcccgggggccggcugggcgggcgcggccgggggcgcgcccccgagcgcgugggcgggcggggccgcggccgggggaccgccgcgccccgcgccgcccccgccgcccggggcucgcgcccggggcccgcgggcaccauggccgccggguccaucaccacgcuccccgcccugcccgaggacggcggcucgggggccuucccgcccggccacuucaaggaccccaagcggcuguacugcaagaacgggggcuucuuccuccgcauccaccccgacgggcggguggacggcguccgcgagaaguccgacccgcacaucaagcugcagcugcaggcggaggagcggggcguggugucgaucaagggggucugcgccaaccgcuaccucgccaugaaggaggacggccggcugcuggccuccaagugcgugaccgacgagugcuucuucuucgagcgccucgagucgaacaacuacaacaccuaccggucccgcaaguacaccucgugguacguggccuuaaagcggacggggcaguacaaguuaggcuccaagaccggccccgggcagaaggcgauccucuucuuacccaugucggccaaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5764 - RNA, 932 nt, Artificial Sequence
  mRNA product Design3 comprising derived and/or modified sequence from Homo sapiens__NP_002000.1__HsFGF7 (opt10)
gggagagucccgcagucggcguccagcggcucugcuuguucgugugugugucguugcaggccuuauucaagcuuaccaugcacaaguggauauuaacguggauauugccgacguuauuauacaggucgugcuuccacauaauaugcuuggucgggacaauaaguuuagcgugcaacgacaugacgcccgagcaaauggcgacgaacguaaauugcucgaguccggagagacacacgaggucguaugacuauauggaggggggcgacauaagagucaggagauuauucugcaggacacaaugguauuugagaauagacaagaggggcaaagucaaggggacgcaagagaugaaaaacaacuauaacauaauggagauaagaacgguagccgucggcauagucgcgauaaaagggguagagagugaguucuauuuagcgaugaacaaggaggggaaguuauaugcgaagaaggagugcaacgaggacugcaauuucaaggaguugauauuagagaaccacuauaacacguacgcgucggccaaguggacacacaacggcggggagauguucgucgcguuaaaccaaaagggcauaccggucagggggaagaagacgaagaaagagcaaaagacggcgcacuucuugccgauggcgauaacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5765 - RNA, 974 nt, Artificial Sequence
  mRNA product Design3 comprising derived and/or modified sequence from Homo sapiens__NP_001936.1__HsHBEGF (opt10)
gggagagucccgcagucggcguccagcggcucugcuuguucgugugugugucguugcaggccuuauucaagcuuaccaugaaguuguuacccucaguuguacucaaauuauucuuagcggccguauuaagugcucuugugaccggcgagucguuggagcguuugcgccgcggucuugcagcgggcacgaguaacccggacccgccgacggucucgaccgaccaguuacucccucucgggggcgggcgcgaccguaagguucgggaccuccaggaggcggacuuagaccuccuacguguuacgcuuucgucgaagccccaggccuuggcgaccccuaacaaggaggagcacgguaagcguaagaagaaggggaaggggcuuggcaagaagcgugacccgugcuugcgaaaguacaaggacuucugcauacacggggagugcaaguacgucaaggaguuacgagcgccgaguugcaucugccacccgggcuaccacggggagcgaugccacggcuugucguuaccgguagagaaccguuuguacacuuacgaccacacuaccauacucgccguagucgcgguugucuuaucgucgguaugcuuauuaguaauaguaggcuuauuaauguuccgauaccaccgacgcgggggcuacgacguagagaacgaggagaaggugaagcuagggaugacgaacucgcacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5766 - RNA, 2534 nt, Artificial Sequence; identical to SEQ ID NO: 5749
  mRNA product Design3 comprising derived and/or modified sequence from Homo sapiens__NP_000592.3__HsHGF (opt10)

SEQ ID NO: 5767 - RNA, 2273 nt, Artificial Sequence
  mRNA product Design3 comprising derived and/or modified sequence from Homo sapiens__NP_005336.3 __HsHSPA1A (opt10)
gggagagucccgcagucggcguccagcggcucugcuuguucgugugugugucguugcaggccuuauucaagcuuaccauggcgaaggcggcggcaauagggauagacuuagguacgacguacucgugcguugguguauuccagcacgguaagguagagauaauagcgaacgaccaggguaaccggacgacgccgaguuacgucgcguucaccgacacggagcgcuugaucggggacgccgcgaagaaccagguagcuuuaaacccacaaaacacgguuuucgacgcaaagcgacucauagggcgaaaguucggggaccccgucguacaaucagacaugaagcacuggccguuccaggucauaaacgacggugacaagccgaagguccagguaaguuacaagggcgagacgaaggcguucuacccugaggagaucucaaguaugguauugacgaagaugaaggagauagcggaggcauacuuaggauaccccgugacgaacgccguaaucacgguccccgcguacuucaacgacucucagcggcaggcgacgaaggacgcaggcguaaucgcaggguuaaacguauugcgcaucauaaacgagccgaccgcggcggcgauagcauacggguuagaccggaccgggaagggugagcgaaacguauuaaucuucgacuuggguggggguacguucgacgucucgauauuaaccaucgacgacggcauauucgagguaaaggcgaccgccggggacacgcacuuaggcggggaggacuucgacaaccgauuggucaaccacuucguagaggaguucaagcgaaagcacaagaaggacauaucgcagaacaagcgugcgguaagaagguuacgaacggcgugcgagcgggcuaagcgcacguuaaguucgaguacgcaggcgucguuggagauagacaguuuauucgaggguauagacuucuacacuucgauaacgcgugcacgauucgaggaguuaugcucggacuuauucaggucgacguuagagccgguagagaaggcauuacgagacgcgaaguuggacaaggcacagauacacgacuuaguauuaguaggugguucgacgcggauaccgaagguacagaaguuguuacaggacuucuucaacggucgagacuuaaacaagucgaucaacccggacgaggcgguagcguacggggccgcgguacaggccgcgauauugaugggugacaagagugagaacguacaggacuuauuauuauuagacguagcacccuuaucuuuggguuuagagaccgcggguggggucaugacggcguuaauaaagcgaaacucgacgaucccgacgaagcagacccagaucuucacuacguacucggacaaccagccggguguauugauccagguauacgagggugagcgagcgaugaccaaggacaacaacuuauuaggacguuucgaguugucggguauaccgcccgcaccucgaggggucccgcagaucgaggucacguucgacaucgacgcgaacgguaucuuaaacguaacggcgaccgacaaaaguacggggaaggccaacaagaucacgauaacgaacgacaagggucgauuaucgaaggaggagauagagaggaugguccaggaggcagagaaguacaaggccgaggacgagguccagagagagcgaguaagugcgaagaacgcguuggagucguacgcguucaacaugaagagugcggucgaggacgaggguuuaaaggguaagaucucggaggccgacaagaagaaggucuuagacaagugccaggagguuauaucuugguuagacgcgaacacguuagcggagaaggacgaguucgagcacaagcgcaaggaguuagagcagguaugcaacccgauaauaucggguuuguaccagggggcgggcgggccggguccgggugguuucggcgcgcagggaccgaagggugguagugggucggguccgacgaucgaggagguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5768 - RNA, 2273 nt, Artificial Sequence; identical to SEQ ID NO: 5767
  mRNA product Design3 comprising derived and/or modified sequence from Homo sapiens__NP_005337.2 __HsHSPA1B (opt10)

SEQ ID NO: 5769 - RNA, 2273 nt, Artificial Sequence
  mRNA product Design3 comprising derived and/or modified sequence from Homo sapiens__NP_005518.3 __HsHSPA1L (opt10)
gggagagucccgcagucggcguccagcggcucugcuuguucgugugugugucguugcaggccuuauucaagcuuaccauggcgacggcgaaggguauagcuauagguauagacuuaggaacgacauacucgugcguaggugucuuccagcacgggaaggucgagaucauagcuaacgaccaggggaacaggacaacgccgaguuacgucgcguucaccgacacugagagauugaucggugacgcggcgaagaaccaggucgcgaugaacccucaaaacacgguauucgacgcgaagcgguuaaucggucgcaaguucaacgacccggucguucaggcggacaugaaguuauggccguuccaaguaauaaacgagggcggaaagccgaagguauugguaucguacaagggugagaacaaggcauucuacccggaagagauaaguucgaugguuuuaaccaaguuaaaggagacagcggaggcguucuuaggucauccgguaacuaacgcgguaaucacgguacccgcuuacuucaacgacagucagcggcaggcgacgaaggacgcgggggucauagcggguuuaaacguauuacgcauaauaaacgagccaacggcagcggcgauagcguacggucuugacaaggggggacagggugagcggcacguauuaaucuucgacuuagguggcgguacauucgacgucucgauauugacgaucgacgacgguauauucgagguaaaggcgacggcgggugacacgcacuuagguggugaggacuucgacaacagauuaguaagucacuucgucgaggaguucaagcggaagcacaagaaggacauaucgcaaaacaagcgcgcuguaaggagauugcggacggccugcgagcgcgcgaagcggacguuaaguucgucgacgcaggcgaaccucgagauagacucguuguacgaggguauagacuuuuacacgaguaucacgcgagcgagauucgaggaguuaugcgccgacuuauuccgcgggacauuggagcccguugagaaggcguuaagggacgcgaagauggacaaggcgaagauccacgacauaguauuagucggugguucgacccgaauaccgaagguacagcgguuauuacaagacuacuucaacggucgcgacuugaacaagucgauaaacccggacgaggcgguagcguacggggcggcaguccaggcggcgauauuaaugggggacaagucggagaagguccaagacuuauuauuguuggacguugcgccguuaaguuuagguuuagagacugcgggcgguguaaugacggcguuaaucaagcggaacucgacaauaccaacgaagcagacgcaaauauucacuacguacagugacaaccagccggguguauugauacagguauacgagggugagcgggcgaugacgaaggacaacaacuuauuaggucguuucgacuuaacugguauaccuccggcuccgcgggggguaccgcaaauagaggucacguucgacauagacgcgaacgggaucuuaaacguaacggcgaccgacaagucgacagguaagguuaacaagauaacuauaacgaacgacaaggguagauuaucgaaggaggagaucgagaggauggucuuggacgcggagaaguacaaggcagaggacgagguacagagagaaaagauagcggcgaagaacgcguuagagaguuacgcguucaacaugaagucgguaguaucggacgagggauuaaaggguaagaucucggagagugacaagaacaagauauuagacaagugcaacgaguuauuaucgugguuggagguuaaccaguuagcggagaaggacgaguucgaccauaagaggaaggaguuagagcaaaugugcaacccgaucaucacgaaguuauaccagggggguugcacggguccggcgugcgguacggguuacgucccugggcgaccggcaacagguccgacgauagaggagguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5770 - RNA, 2267 nt, Artificial Sequence
  mRNA product Design3 comprising derived and/or modified sequence from Homo sapiens__NP_068814.2 __HsHSPA2 (opt10)
gggagagucccgcagucggcguccagcggcucugcuuguucgugugugugucguugcaggccuuauucaagcuuaccaugucggccagggggccggccauagggaucgauuuggggacgacguauagcugugucggggucuuucaacaugggaagguggagaucauagccaaugaucagggcaaucgcacgaccccgaguuacgucgcguucaccgauacggagagguugauaggggaugccgcgaaaaaucaagucgccaugaauccgaccaauaccauauuugaugccaaacgcuugauagggaggaaauuugaggaugccaccgugcagucggauaugaaacauuggccguuuagggucgucagugagggggggaagccgaaaguacagguggaguauaagggggaaaccaaaacguucuuuccggaggaaauaagcucgauggucuugacgaagaugaaggagaucgccgaagccuacuugggggggaaagugcauucggccgucaucaccgugccggccuauuucaaugauucgcagcgccaggccaccaaggaugccgggacgaucaccggguugaauguguugaggaucauaaacgagccgaccgccgccgccauagccuauggguuggauaaaaaggggugugcggggggggaaaagaauguguugaucuuugauuuggggggcgggaccuuugaugugagcaucuugacgaucgaggaugggauauuugaagugaagucgaccgcgggggauacccauuuggggggcgaggauuuugauaauaggauggucucgcacuuggcggaggaauuuaagcgcaaacauaaaaaggacaucgggccgaauaagagagccguccgccgcuugcgcacggccugugagagagccaagcgcacguugucgagcucgacccaggccucgaucgagauagauaguuuguaugagggcgucgauuuuuauacgagcauaaccagagcgagguucgaagaguugaaugcggacuuauuuagggggaccuuggagccgguggagaaggccuugagggaugccaagcucgauaaggggcagauccaggagaucguguuagugggggggaguacgaggauaccgaagauacagaaguuguugcaggauuuuuuuaauggcaaggaguugaauaagagcaucaauccggacgaggccguggcguauggggccgccguccaggccgccaucuugauaggcgauaagucggaaaaugugcaggauuuguuguuauuggaugucacgccguugagcuugggcaucgaaaccgccgggggggucaugacgccguuaaucaagaggaauaccacgaucccgaccaagcaaacgcaaacguuuaccacguauucggauaaucaaagcagugucuuggugcaagucuaugaaggggagagggccaugaccaaggauaauaauuugcucgggaaauuugauuugaccgggauccccccggccccgaggggggucccgcagauagaggugaccuucgauaucgaugcgaaugggauauugaaugucacggccgcggauaagucgaccggcaaagagaauaaaauaaccaucaccaaugauaagggccgcuuaucgaaggaugauaucgauaggauggugcaggaggccgagagguauaagagcgaggacgaagccaaucgcgauaggguggccgccaaaaaugccuuagagagcuauacguauaauauaaaacaaacgguggaggaugagaaguuaagggggaagaucucggagcaggauaagaauaagaucuuagauaagugccaggaggugaucaauugguuggauaggaaucagauggcggagaaggaugaguaugagcauaagcagaaggaguuggagagggucuguaauccgaucauaagcaagcucuaucagggggggccgggggggggcucgggggggggggggaguggggccucgggggggccgacgauagaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5771 - RNA, 2870 nt, Artificial Sequence
  mRNA product Design3 comprising derived and/or modified sequence from Homo sapiens__NP_002145.3 __HsHSPA4 (opt10)
gggagagucccgcagucggcguccagcggcucugcuuguucgugugugugucguugcaggccuuauucaagcuuaccaugucagucguagguaucgaccucgguuuucaaaguuguuacguagcgguagcgcgagcuggagguauagagacgauagcaaacgaauacucggaccgaugcacuccugcgugcauaucguucgggccgaagaacaggucgauaggggccgcggcaaagucgcagguuaucucaaacgcgaaaaacacgguacaggguuucaagcgauuucacggucgugcguucucggacccuuucgucgaggccgagaagaguaacuuagcguacgacauaguucaauuaccgacgggucucacgggcauuaagguaacuuacauggaagaggagcgcaacuucacuacggagcagguaacggcgauguuguuaucgaaguuaaaggaaacggcagagucgguauuaaagaagccagugguagacugcguaguaucaguaccgugcuucuacacggacgcggagcggcguucgguuauggacgccacgcagauagcggggcucaacuguuuacgccuaaugaacgagacgacggccguagcguuagcguacgggauuuacaagcaggacuugccagcgcuugaggagaagccgcgcaacguuguauucguggacaugggacacucggcauaccaggugucggucugcgcguucaaccgggggaagcucaaggucuuagcgacggcguucgacaccacguuaggcggacgcaaguucgacgagguacucguuaaccacuucugcgaggaguucgguaagaaguauaaguuagacauaaagucgaagauucgagcguugcuucguuuaucgcaggagugcgagaaguuaaagaaguuaaugucagcgaacgcgucggacuugccccuuucgaucgagugcuucaugaacgacguagacguuucagggaccaugaacagggggaaguucuuagagauguguaacgacuuauuggcacgagucgaaccucccuugaggucggucuuagagcagacaaaguugaagaaggaggacauauacgcgguagagaucgucggaggggcaacgcguauuccggcaguuaaggagaagauaucgaaguucuucggcaaggaguuaucgacgacgcuuaacgcggacgaggcgguaacgagggguugcgcguuacagugcgcuauacuuucuccagcguucaagguacgcgaguucucgauaacggacguuguuccguaccccaucaguuuacgguggaacucgccggcggaggaggguucgucggacugcgagguguucucgaagaaccacgcggcgcccuucucgaaggucuuaacguucuaccgaaaagagccguucacauuagaggcauacuacaguucgccacaggaccuuccuuacccggacccggcgaucgcacaguucucgguacaaaagguuacgccccagucggacgguucgucgucgaaggucaagguaaaggugaggguuaacguucacgguaucuuuucggucaguucggcgucgcuuguagagguccacaagucggaggagaacgaggagccgauggagacggaccagaacgcgaaagaggaggagaaaaugcagguagaccaggaggagccgcacguagaggagcagcaacagcagacgccggcggagaacaaggcggagucggaggagauggagacuucgcaggcgggcucgaaggacaagaaaauggaccagccuccgcaggcgaaaaaggcgaaggucaagacaucuaccgucgacuuaccgauagagaaccaguuauuguggcaaaucgaccgagagauguuaaacuuauacaucgagaacgaggggaaaaugaucaugcaggacaaguuggaaaaggagcgcaacgacgcgaaaaacgcgguugaggaguacguuuacgagaugcgugacaaguuaucgggcgaguacgagaaguucgucucggaggacgaccgaaacucauucacguuaaaguuggaggacacggagaacugguuauacgaggacggggaggaccaaccgaagcagguauacgucgacaagcuagcggagcuuaagaacuugggacagcccauaaagaucagguuccaagagagugaggagcgcccgaagcuauucgaggaguuagguaagcaaauacagcaguacaugaagaucauaucuaguuuuaagaacaaggaggaccaauacgaccacuuagacgcggcagacaugacuaaggucgagaagaguacgaacgaggcgauggaguggaugaacaauaaguuaaacuuacaaaacaagcagucguuaacgauggacccgguaguaaagucgaaggagaucgaggccaagaucaaggaguuaaccucuacaugcucgccaaucauaucgaagccgaagccgaagguagagccgccgaaggaggagcagaagaacgccgagcaaaacggccccguagacggucagggugacaaccccgggccucaggcggcagaacaggggacggacaccgcgguaccgucugacucggacaaaaaguuaccggagauggacaucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5772 - RNA, 2867 nt, Artificial Sequence
  mRNA product Design3 comprising derived and/or modified sequence from Homo sapiens__NP_055093.2 __HsHSPA4L (opt10)
gggagagucccgcagucggcguccagcggcucugcuuguucgugugugugucguugcaggccuuauucaagcuuaccaugagcgucgucgggaucgauuugggguucuugaauuguuauauagccguggcccgcucgggggggauagaaacgauagcgaacgaauauucggaucgcuguacgcccgcgugcaucagccucgggagccgcaccagggcgauagggaacgccgccaaaucgcaaaucgugaccaauguccgcaacaccauccacggguuuaagaaauugcacggcaggagcuucgacgauccgaucguccagaccgagcgcauacgcuugccguacgaauuacaaaagaugccgaacgggucggccggggucaaagucagauaucucgaagaggaacgcccguucgccaucgaacaagucaccgggauguuacucgcgaaauugaaggaaaccagcgagaacgcccucaaaaagccggucgccgauugcgucaucagcaucccgucguuuuucaccgacgcggaacgccgcagcgucauggccgccgcgcaagucgccgggcucaacugccuccgccucaugaacgagaccaccgccgucgccuuagccuacgggaucuacaagcaagacuugccgccgcucgacgaaaagccgcgcaacgucgucuucaucgacauggggcauagcgcguaccaagugcucgucugcgccuuuaauaaagggaaguugaaggugcucgccaccacguucgacccguaccucggggggcgcaauuucgacgaagcccucgucgauuauuuuugcgacgaauuuaaaacgaaguacaaaaucaacgucaaggagaauagcagagcgcuccucaggcucuaccaagaaugcgagaaguugaaaaaauugaugucggccaacgccagcgacuugccgcucaauaucgaaugcuuuaugaacgauuuggacgucagcucgaagaugaaucgcgcccaguucgaacaauuaugcgccaguuugcucgcgcgcgucgagccgccgcucaaagccgucauggagcaagccaaucuccaaagggaggauaucucgucgaucgagaucgucgggggggccaccaggaucccggccgucaaggagcaaauaaccaaguuuuucuugaaggauaucucgacgacccucaacgccgacgaggccgucgcccgcgggugcgcccuccaaugcgccaucuugagcccggccuucaaggucagggaguucaguaucaccgauuuggucccguacagcauaacccuccgcuggaaaacgagcuucgaggacgggucgggcgagugcgaggucuuuugcaaaaaucauccggcgccguuuagcaaagugaucaccuuucauaaaaaagagccguucgaguuggaggccuucuacaccaaccuccaugaggucccguauccggacgcccgcaucggcucguuuaccauccaaaacgucuucccgcaaagcgacggggacucgaguaaggucaaagucaaggucagggucaauauacacgggauauuuucggucgccucggccagcgucaucgaaaaacagaaccucgagggggaccauucggacgccccgauggaaaccgagaccagcuucaagaacgagaauaaggacaacauggacaagaugcaagucgaccaagaggagggccaccagaagugccacgccgagcauaccccggaggaagagaucgaccauaccggggcgaagaccaaaagcgccgugagcgauaagcaagauaggcucaaccaaaccuugaagaaggggaaaguaaagucgaucgacuugcccauacaaucgucguugugccgccaauuggggcaagacuuguuaaauucguauaucgagaacgaaggcaaaaugauaaugcaagacaaacucgaaaaggagcgcaacgacgccaaaaacgcggucgaggaguacgucuacgacuuccgcgaucgcuuagggaccguguacgagaaguuuauaaccccggaagaucucucgaaauuaagcgccguccucgaggauaccgaaaacugguuguacgaggauggggaagaucaaccgaagcaggucuacgucgacaaauugcaggaguugaaaaaguaugggcaaccgauccaaaugaaauauauggaacacgaagaacgcccgaaggcgcucaacgaucucgggaaaaaaauacaauuggugaugaaagucaucgaagccuaccgcaauaaagacgagcgcuacgaccacuuagacccgaccgaaauggagaaagucgagaagugcauaucggacgcgaugucgugguuaaacucgaaaaugaacgcccaaaauaaguugucguugacccaggacccggucgucaaggucagcgagaucgucgccaaaagcaaagaguuagacaacuuuugcaauccgauaaucuauaaaccgaaaccgaaggccgaggucccggaggauaagccgaaggccaacucggaacauaacgggccgauggacgggcaaucggggaccgagaccaagagcgacagcaccaaggauucgagccaacacaccaaaaguagcggggaaauggaggucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5773 - RNA, 2312 nt, Artificial Sequence
  mRNA product Design3 comprising derived and/or modified sequence from Homo sapiens__NP_005338.1__HsHSPA5 (opt10)
gggagagucccgcagucggcguccagcggcucugcuuguucgugugugugucguugcaggccuuauucaagcuuaccaugaaauugaguuuagucgcggccauguuauuauuauugucggccgccagagcggaagaagaagauaaaaaagaagaugucgggaccgucguggggauagauuuaggcacgacguauaguugugugggggucuuuaaaaaugggagggucgaaauaauagcgaaugaccaagggaauaggauaacccccaguuacguggcguuuaccccggagggcgagagguuaaucggggacgcggcgaaaaaucaauugacgaguaauccggaaaauaccguguucgaugcgaaaagauugauagggaggaccuggaacgaucccagcguccaacaagauauaaaauuucuccccuuuaaagucgucgagaaaaagaccaagccguauauccaggucgacaucggggggggccagaccaaaaccuucgccccggaggagaucagcgcgauggucuugaccaagaugaaggagacggccgaagccuaccucgggaaaaaagucacgcacgccgucgucaccgucccggcguacuucaacgacgcgcagaggcaggccacgaaggaugccgggaccaucgccggguugaacgucaugcgcauaauaaaugaaccgaccgccgccgccaucgccuacggguuagacaaacgcgaaggcgaaaaaaauauauuagucuucgauuuagggggggggacguuugacgucagcuuguugacgaucgauaacgggguguuugaggucgucgcgaccaacggggacacccacuuagggggggaggauuucgaucaaagggugauggagcauuuuauaaaguuauauaagaaaaaaaccgggaaggacgugcgcaaggauaaccgcgccguccaaaaguugagaagggaagucgagaaagcgaagagagcguuaagcagccaacaccaggcccgcaucgagaucgaaaguuuuuacgagggggaggauuucagcgaaacguuaaccagagcgaaguucgaggaauugaauauggacuuauuuagaagcaccaugaaaccggugcaaaagguccucgaggacagcgaccucaaaaaaagcgacaucgacgagaucgucuuggucggggggagcaccaggaucccgaaaauccaacaguuagucaaggaauuuuuuaacgggaaagagccgaguagggggaucaauccggacgaggccgucgccuacggggccgccgugcaagccggggucuugagcggggaccaggacaccggggauuuagucuuauuggacgucugcccguugaccuuggggaucgagaccgucgggggggugaugacgaaguuaaucccgcgcaauaccgucgucccgacgaaaaaaagccaaauauucagcaccgccagcgacaaccagccgaccgucaccauaaaaguguacgagggggagcgcccguuaaccaaggauaaccacuuguuagggaccuucgacuuaaccgggaucccgccggccccgaggggcgugccgcaaaucgaggugacguucgaaaucgacgucaacgggaucuugagggucaccgccgaggauaaagggaccggcaauaagaacaaaauaaccauaacgaacgaucaaaacagguuaaccccggaggagauagagcgcauggucaacgacgccgaaaaauucgccgaagaggauaagaaauugaaagaaaggaucgacacccgcaacgaacucgagucguacgcguacagcuugaaaaaccaaaucggggacaaggagaaauuaggggggaaguugaguagcgaggacaaagaaacgauggagaaggccgucgaggagaaaaucgagugguuagagucgcaucaggacgccgauaucgaggauuuuaaggccaaaaaaaaagaguuagaggagaucguccagccgaucauaucgaaguuguacgggucggccgggccgccgccgaccggggaggaagacaccgccgagaaggacgaacucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5774 - RNA, 2279 nt, Artificial Sequence
  mRNA product Design3 comprising derived and/or modified sequence from Homo sapiens__NP_002146.2__HsHSPA6 (opt10)
gggagagucccgcagucggcguccagcggcucugcuuguucgugugugugucguugcaggccuuauucaagcuuaccaugcaagcgccgagagaauuggccgucgggauagauuuagggacgacguauagcugugucggggucuuccaacaagggagggucgaaauauuagcgaaugaucaagggaauaggacgaccccgucguaugucgcguuuacggauacggaaagauuagugggcgaugccgcgaaaucgcaagccgcguuaaauccgcauaauacggucuuugacgcgaaaagauuaauaggcaggaaauuugccgauacgaccguccaaagcgauaugaaacauuggccguuuagagucgucucggaaggggggaaaccgaaagucagggucuguuauaggggcgaagauaaaaccuuuuauccggaagaaauaagcaguauggucuuaucgaaaaugaaagaaaccgcggaagccuauuuagggcaaccggucaaacaugccgucauaacggucccggcguacuuuaacgauagccaaaggcaagcgacgaaagaugccggcgcgauagccggcuugaauguccucagaauaauaaacgaaccgaccgccgccgcgauagcguacggcuuagauagaagaggggccggggaaaggaaugucuugaucuucgauuuagggggcgggacguuugacgucagcgucuugaguaucgaugccgggguguucgaagucaaggcgaccgccggggacacgcauuuagggggggaagauuuugauaauagauuggucaaucauuuuauggaggaguuuagaagaaaacacggcaaagauuuaucgggcaauaaaagggcguuaaggcgcuuaaggaccgcgugcgaaagggcgaaaaggacguuaaguaguucgacgcaagcgacguuagaaaucgauaguuuauuugaaggggucgauuuuuauaccaguauaaccagggcgagguucgaagaguuauguagcgauuuguuuaggucgacguuagaacccgucgaaaaagcguuaagagacgcgaaauuagauaaagcgcaaauccacgaugugguguuagucggcgggaguaccaggauaccgaaaguccaaaaacucuuacaagauuuuuuuaaugggaaagaauuaaauaaaucgauaaauccggacgaagccgucgcguacggcgccgccguccaagccgcgguccucaugggcgauaagugcgaaaagguccaagacuuguuauuauuagacgucgccccgcucagcuuaggcuuagaaaccgccgggggcgucaugacgaccuuaauacaacgcaaugcgaccauaccgacgaaacaaacgcaaaccuuuacgacguauagcgauaaucaaccgggcguguuuauacaagucuacgaaggggaacgcgcgaugacgaaagauaauaauuuauuaggcagguucgaguugucggggauaccgccggcgccgaggggggugccgcaaaucgaagucaccuucgauaucgacgccaacgggauauuaucggucaccgcgaccgaucgcucgaccgggaaagccaauaaaauaacgauaacgaacgauaaagggagauuaucgaaagaagaagucgaacgcaugguccacgaggcggaacaauauaaagccgaagacgaagcgcaacgcgaucgcgucgccgcgaagaauagcuuagaagcgcacguguuucacgucaaggggagccuccaggaagagucguugcgcgauaaaaucccggaggaagaucgcaggaagaugcaggauaaaugcagagagguguuggcgugguuagaacauaaucaauuagccgaaaaagaagaauacgaacaccaaaaacgcgaauuagaacagauaugcaggccgauauuuagucgcuuguacggcggcccgggggugccgggcgggucgucgugcgggacccaggcgaggcaaggcgauccgucgacggggccgauaaucgaagaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5775 - RNA, 1451 nt, Artificial Sequence
  mRNA product Design3 comprising derived and/or modified sequence from Homo sapiens__P48741__HsHSPA7 (opt10)
gggagagucccgcagucggcguccagcggcucugcuuguucgugugugugucguugcaggccuuauucaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagucgcaggccgcgcucaacccccacaacacgguguucgacgccaagcgcuuaaucggccggaaguucgccgacaccaccguccagagcgacaugaagcacuggcccuuccagguggugucggagggcgggaagcccaaggucagggugugcuaccggggcgaggacaagaccuucuacccggaggagaucagcagcaugguguuauccaagaugaaggagacggccgaggcguaccucgggcagcccgucaagcacgccgugaucaccgugcccaccuacuucucgaacagccagaggcaggccaccaaggacgccggcgccaucgcggggcugaaggucuuacccaucaucaacgaggccacggccgccgccaucgcguacggccucgacagacgcggcgccgggaagcggaacgugcugaucuucgacuuaggcgggggcaccuucgacgugagcgucuugaguaucgacgccggcguguucgaggugaaggccaccgccggggacacccacuuaggcggggaggacuucgacaaccgccuggucaaccacuucauggaggaguucagacgcaagcacggcaaggaccucucggggaacaagcgggcguuaaggcgguuaaggacggccugcgagcgggccaagaggaccccgaguagcuccacccaggccacccucgagaucgacagcuuauucgagggcguggacuucuacaagaguaucacgcgggccagguucgaggaguuaugcagcgacuuguucagguccaccuuagagcccguggagaaggcguuaagagacgccaagcucgacaaggcccagauccacgacuucgucuuaggcgggggccugcacagccacccccagggggccgagguggcggccggccuccugcagcgccagggggccgagcaggagcaccagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5776 - RNA, 2288 nt, Artificial Sequence
  mRNA product Design3 comprising derived and/or modified sequence from Homo sapiens__NP_006588.1 __HsHSPA8 (opt10)
gggagagucccgcagucggcguccagcggcucugcuuguucgugugugugucguugcaggccuuauucaagcuuaccaugucgaaggggccggcgguagguauagacuuaggcacgacguacucgugcguagggguauuccagcacggcaagguagagaucaucgcgaacgaccaggggaaccgaacaacgccgucguacguagcauucaccgacacggagcgcuuaauaggcgacgcggcgaagaaccagguagcgaugaacccgacuaacacggucuucgacgcgaagcgguuaaucggucgacgguucgacgacgcgguaguacagucggacaugaagcacuggcccuucauggucguuaacgacgcagguagaccgaagguacagguggaguacaagggcgagaccaagucguucuacccggaggaggucucgucgaugguguuaaccaagaugaaggagaucgcggaggcguacuuggguaagacggugacgaacgcagucguuacggucccggcguacuucaacgacagucagcgacaggcgacuaaggacgcggguacgaucgcgggauuaaacgucuuacgaaucaucaacgagccgacggcggccgcgauagcguacgggcuagacaagaagguaggugcggagaggaacguauuaaucuucgacuuggggggcgggacguucgacguaucgauauuaaccaucgaggacgguauuuucgagguaaagaguaccgcaggggacacccacuuagggggggaggacuucgacaaccguaugguaaaccacuucauagcggaguucaagcggaagcacaagaaggacauaucggagaacaagcgcgccguacgacguuuacggacggcgugcgagagagcgaagcgaaccuuaaguucgaguacucaggcaucgauagagauagacucguuauacgaggggaucgacuucuacacgucgaucacgcgagcgcgguucgaggaguugaacgccgacuuguuccgagggacgcuugacccgguggagaaggcguuacgggacgcuaaguuagacaagagucagauacacgacauaguauuaguaggggggucgacgcgaaucccuaagauacagaaguuauugcaggacuucuucaacggcaaggaguuaaacaagaguauaaacccggacgaggcaguagccuacggggcggcgguacaggcggcgauucucucgggugacaagucggagaacgugcaggacuuauuauuauuagacguaacgcccuuaucgcucgggaucgagacggcgggggggguaaugacgguauugaucaagaggaacacgacgauaccgacgaagcaaacgcagacguucacgaccuacucggacaaccagccgggcguauuaauacagguauacgagggcgagcgggccaugacgaaggacaacaaccuuuuagguaaguucgaguuaacggguauuccgccggcgccgagggggguaccgcaaaucgagguaacguucgacauagacgcgaacgggauccuuaacguaagugcgguagacaagucgacggguaaggagaacaagaucacgauaacgaacgacaagggccgcuuaaguaaggaggacaucgagcgcaugguacaggaggcggagaaguacaaggcggaggacgagaagcagcgagacaagguaucgucgaagaacucguuggagaguuacgcguucaacaugaaggcgacgguagaggacgagaaguuacaggguaagaucaacgacgaggacaagcagaagaucuuggacaagugcaacgagauaaucaacugguuagacaagaaccagacggcggagaaggaggaguucgagcaccagcaaaaggaguuagagaagguaugcaacccgaucauaacgaagcuauaccaguccgcgggugggaugccgggggggaugccgggcgguuuccccggagggggugccccgccgagugggggggcgucgucgggcccgacgaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5777 - RNA, 2387 nt, Artificial Sequence
  mRNA product Design3 comprising derived and/or modified sequence from Homo sapiens__NP_004125.3 __HsHSPA9 (opt10)
gggagagucccgcagucggcguccagcggcucugcuuguucgugugugugucguugcaggccuuauucaagcuuaccaugaucucggcgucgagggccgccgccgcgagguuggucggggcggccgcgaguagagggccgaccgcggcgaggcaucaagacucguggaacggguugucgcacgaagccuuccgcuuggucagccgcagagacuacgccagcgaggcgauaaaaggggccgucgucgggaucgaucucgggaccacgaauaguugugucgccgucauggaggggaagcaagcgaaagucuuagaaaacgcggagggggcgcgcacgacgccgagcgucgucgcguucaccgccgacggggaaagguuggucgggaugcccgcgaaaaggcaagccgugacgaauccgaauaauaccuucuacgccacgaaaagguugaucgggagaagguacgacgacccggagguccaaaaggauaucaagaacgucccguuuaagaucgugagggcgaguaacggggacgcgugggucgaagcccauggcaagcucuacagccccucgcaaauaggggccuucguccucaugaaaaugaaggaaaccgccgagaacuaucucggccauaccgccaagaacgccgucauaaccgugccggccuacuuuaacgauagccaacgccaagcgaccaaagacgccgggcaaauuagcggguuaaacgucuugagagucaucaacgaaccgaccgccgccgccuuggcguacggguuggauaagagcgaggauaagguaaucgccgucuacgaccucgggggggggaccuucgacaucagcauauuagagauccaaaagggggucuucgaagucaagaguaccaacggcgacacguuucucgggggcgaggauuucgaucaagcgcucuugagacauaucgucaaagaauuuaaacgcgaaaccggcgucgaccucaccaaagauaauauggccuugcaacgcgucagagaggccgccgagaaagccaagugcgaguugaguagcagcguccaaaccgauauaaaccucccguacuugaccauggacagcagcgggccgaaacaccucaacaugaaacucacgagggcccaguucgagggcaucgugaccgacuugauacgccgcaccauagccccgugucaaaaggccaugcaggacgccgagguaucgaaaucggauaucggggaggucauauuggucggggggaugacccgcaugccgaaaguccaacaaaccguccaagauuuguucgggcgcgcgccgucgaaagccgugaacccggacgaagccgucgcgaucggggccgcgauccaaggggggguccucgcgggggacgugaccgacgucuuauuguuggacgugaccccgcucagcuuagggaucgagaccuugggggggguguucacgaaguugaucaaccgcaacacgaccaucccgacgaaaaaaucgcaagucuuuagcaccgcggccgacgggcagacccaggucgagaucaaggucugucaaggggagcgcgaaauggccggggauaauaaguuguuggggcaauucacccucaucgggaucccgccggcgccgaggggggucccgcaaaucgaggucaccuucgauaucgacgcgaacggcaucguccacgucagcgccaaggacaaggggaccgggagggaacaacaaaucgucauacaaagcagcggggggcucucgaaggacgacaucgagaacauggucaaaaacgccgaaaaauacgccgaggaggauagaaggaaaaaagagagggucgaggcggucaauauggccgaggggauaauccaugauaccgaaacgaaaauggaagaguuuaaagaucagcucccggccgacgaauguaauaaauuaaaggaggaaaucaguaagaugcgcgaauuguuagcccgcaaagauucggaaaccggggagaacauccgccaagccgcgaguagcuugcaacaagccagcuuaaaauuauuugagauggccuauaaaaaaauggccagcgaaagggaggggagcgggucgagcgggaccggcgagcaaaaagaggaccagaaagaagagaaacaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5778 - RNA, 2375 nt, Artificial Sequence
  mRNA product Design3 comprising derived and/or modified sequence from Homo sapiens__NP_079291.2__HsHSPA12A (opt10)
gggagagucccgcagucggcguccagcggcucugcuuguucgugugugugucguugcaggccuuauucaagcuuaccauggcagacaaggaagcaggggguucggacggcccucgugagacugcaccuacuucggcguacucuucgccggcucgaucguuaggugacacugggaucacgccguuaaguccgucgcacauaguaaacgauacggacaguaacguaucggagcagcagucguucuuaguaguaguagcgguggacuucgguaccacgucgucggguuacgcguacucguucacgaaagagccggagugcauacacgucaugcggaggugggaggggggagacccgggcguaaguaaccagaagacaccuacgacgauauuauuaacgccggagcggaaguuccacucguucgguuacgcggcccgugacuucuaccacgacuuagacccaaacgaggcaaagcaaugguuauacuuggagaaauucaaaaugaaguuacacacuacgggagacuuaacgauggacacugacuugacugccgcgaacgguaaaaagguaaaggcgcucgagaucuucgcguacgcauuacaguacuucaaggagcaggccuuaaaggagcucucugaccaggcugggucagaguucgagaacagugacguaagguggguaauaacuguaccggcgauauggaagcagccagcgaagcaguucaugcgccaggcagcguaccaggcgggguuagcgucgccggagaacagugagcaguuaauaaucgcuuuagaaccggaagcggcgucgauauacugccggaaguuacguuuacaccaaaugauagaguuaucaaguaaggcggcgguuaacggguacucagguucggacacuguuggggcggguuucacgcaggcgaaggagcacauccgacgaaacaggcaaucgcgcacauuccucgucgagaacguuauuggcgagauuuggagugagcuugaggagggagacaaguacguaguaguagacucgggugggggaacuguugauuuaacgguacaccaaauuaggcucccagagggucacuuaaaggagcucuacaaggccacgggugguccguacgguagucucgggguugacuacgaguucgagaaguugcucuacaagaucuucggugaggacuucauagagcaguuuaagaucaagcguccggcggcguggguagaccucaugauagcuuucgaaucgcgaaagcgcgccgcagcgccggaccgaacgaacccuuugaacaucacguuaccguucucguucauagacuacuacaagaaguuccguggacacucgguagagcacgcguuacgaaagaguaacguagacuucguaaaguggucgagucaggguaugcuucgcaugucgcccgacgcgaugaacgcguuauucaagccuacuaucgacucgauaauagaacacuugagggacuuauuccagaagccggagguaucgacgguaaaguucuuauucuuagucgggggguucgcagaggcgccguuguuacagcaggcaguucaggcggcguucggugaccagugccgaauaauaauaccccaggacguaggguuaacgaucuugaagggggcgguuuuauucggguuagacccggccguaauaaagguucgacguucacccuugacuuacggugucggcgucuuaaaccgauacguagaggggaagcacccaccggaaaaguuguuagucaaggacggaacacgauggugcacggacguauucgacaaguucauaucggccgaccaaaguguagcguuaggcgaguuaguaaagcgaucguauacgccugccaagccgucgcaauuaguaauagucaucaacaucuacaguucggagcacgacaacguaaguuuuauaacggacccgggagucaagaagugcggaacauuaagguuagacuugacggguacgucggguaccgcgguuccagcgcgccgagagauacagacgcucaugcaguucggugacacggagauaaaggcgacggcgauagacaucgcuacgucuaagucgguaaaggucgguaucgacuuucucaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5779 - RNA, 2408 nt, Artificial Sequence
  mRNA product Design3 comprising derived and/or modified sequence from Homo sapiens__NP_443202.3 __HsHSPA12B (opt10)
gggagagucccgcagucggcguccagcggcucugcuuguucgugugugugucguugcaggccuuauucaagcuuaccauguuagcaguacccgagaugggauuacaagguuuauacauagguucgucgcccgagcguucgccgguuccgucgccuccggggucgccacgcacgcaagagucgugcgggauagcaccuuuaacuccuucccagaguccuaagccggaaguucgugcaccgcagcaggcaucguucagugucguagucgcuauagacuucgguacaacaucgucggguuacgccuucucguucgcuucggacccggaggcaauccauaugaugcguaagugggaggguggugacccuggugucgcgcaccaaaagacgccuacgugcuuauuauuaacgccugagggggcguuccacucguucggauacacggcgcgagacuacuaccacgacuuggaccccgaggaggcucgcgacugguuauacuucgaaaaguucaaaaugaagauacacucggcgacugacuuaacguuaaagacacaacucgaggcgguuaacgggaagacaaugccggcguuagaggucuucgcgcacgcguugagguucuuccgcgagcacgcgcuccaggaguuacgagagcaaucgccgucauugccggagaaagacacgguccguugggucuuaaccgucccggcgaucuggaagcaaccggcgaaacaguucaugcgagaggcggcuuauuuagcgggguuaguaucgcgugagaacgcggagcaauuauuaauagcguuagagccggaggcggcgucaguuuacugucgaaaguugcgauugcaccaguuguuagauuuaucaggaagggcgccgggaggcgggcgauugggcgagaggcgaucgauagacucgucguuccgacaggcgcgcgagcagcuccgucguucgaggcauucgcggacguucuuaguagagucggguguuggugaguuaugggcggaaaugcaggcgggugaccguuacguagucgcugacugcgguggggggacgguagacuuaacaguucaccaguuagagcagccacacgguacguugaaagagcuuuacaaggcgucaggagggccguacggggccguagggguugauuuagcguucgagcaguugcucugccggaucuucggcgaggacuucaucgcaacauucaagcgccagcguccagcggcaugggucgacuuaacaauagcguucgaggcacguaagcggacggcaggaccgcaucgagcgggugcauuaaacauaaguuuaccguucucguucauagacuucuaccggaagcaacgcggucacaacguagagacggcgcucaggcgaaguucggucaacuucguaaaguggaguucgcaggguauguugcgcaugaguugcgaggcgaugaacgaguuauuccagccaacaguuucaggcauuauacagcacauugaggcauuauuggcgcgccccgagguacagggggucaagcucuuauucuuggucggaggauucgcggagucggcaguauuacagcacgcaguacaagcggcuuuaggugcgaggggcuuacgcguaguaguaccccacgacgucgguuugacuauauugaagggcgccguuuuauucggucaggcuccgggagucgucaggguucgacggucuccauuaacuuacggugucgguguauuaaaccguuucguccccgguaggcacccgccggagaaguuauugguacgagacggucgaagguggugcacggacguguucgagcguuucguagcagcggaacagucagucgcguuaggagaggagguaaggcguucguacuguccugcaaggccaggacagcgucgagucuuaauuaacuuguauuguugcgcagcggaggacgcacgauucauaacugacccggguguacggaagugcggugccuuaaguuuggaguuagaaccggcggacugcggucaggacacggcgggugcaccaccgggucgucgagagauccgagcagcgaugcaauucggugauacugagauaaaggugacggcgguagacguuucgacuaacaggucgguccgagcaucgaucgacuucuuaucgaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5780 - RNA, 1763 nt, Artificial Sequence
  mRNA product Design3 comprising derived and/or modified sequence from Homo sapiens__NP_008879.3__HsHSPA13 (opt10)
gggagagucccgcagucggcguccagcggcucugcuuguucgugugugugucguugcaggccuuauucaagcuuaccauggcgcgcgaaaugacuauacucgggucugcggucuuaacguuacucuuagcagguuacuuagcgcagcaguaccuuccucuuccgacacccaagguaauaggaauagacuuagguacgacauacugcagugucggaguauucuucccgggaacugguaaggucaagguaauaccggacgagaacggacacaucucuaucccgucgauggucucguucacggauaacgacguuuacgucggguacgagucggucgaguuagcggacucuaacccgcagaacacgaucuacgacgcuaagcgauucaucgguaagauauucacggcggaggaguuagaggcagagauagguagguacccguucaaggucuugaacaagaacgggaugguagaguucucaguaaccucgaacgagacgaucacuguaagucccgaguacgucgguucacguuuacuauuaaaguugaaggagauggcggaggcguacuugggcaugccgguagcgaacgcaguaauaucgguccccgccgaguucgacuuaaagcaacgaaacucgacgaucgaggcggcgaacuuagcggggcuuaagauccuucgagugaucaacgagccgacggcggcggcgauggccuacggguuacacaaggccgacguauuccacgugcuugucaucgacuuaggaggugggacacucgacgucucgcuuuugaacaagcaggguggaauguucuugacgcgugcgaugucggguaacaacaaguugggugggcaggacuucaaccagcgauuauuacaguacuuguacaagcaaauuuaccagacguacgguuucgucccgucacgaaaggaagagauacaucgauuaaggcaggcagucgagaugguaaaguugaacuugacguuacaccagucggcgcaauuaagugucuuguuaacgguugaggagcaggaccguaaggagccgcacucgucggacaccgaguuaccgaaggacaaguugucgucggcugacgaccacaggguaaacucggguuucggcagggguuuaucagacaagaagucgggcgagucgcagguacucuucgagacggagaucagucgaaaguuauucgacacguuaaacgaggacuuauuccaaaagaucuuaguuccgauccagcagguuuuaaaggagggucacuuagagaagacggagauagacgagguugucuuggucggugguucgacgcgaaucccccgaaucaggcagguaauacaggaguucuucgggaaggacccaaacacgucggucgauccggacuuagcgguuguuaccgguguugcgauucaggccgggauagacggggguucguggccguuacagguaucagcgcucgagauaccgaacaagcacuugcagaagacgaacuucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5781 - RNA, 1877 nt, Artificial Sequence
  mRNA product Design3 comprising derived and/or modified sequence from Homo sapiens__NP_057383.2__HsHSPA14 (opt10)
gggagagucccgcagucggcguccagcggcucugcuuguucgugugugugucguugcaggccuuauucaagcuuaccauggccgcgauagggguccauuuaggguguacgagcgcgugcgucgcgguguacaaagacgggagagccggggucgucgccaacgacgcgggggauagggucaccccggccgucgucgccuauagcgagaacgaggaaaucgucgggcucgccgccaagcagucgcgcauccgcaacaucagcaauaccgucaugaaggucaaacaaauauuagggcgcucgaguucggauccgcaggcgcaaaaguauauagccgagucgaagugccucgugaucgaaaagaacggcaagcucagguacgagaucgacaccggggaggagaccaaguucgucaauccggaggacgucgcgcgcuuaauuuuuucgaaaaugaaggagaccgcccacagcguccucgggagcgacgccaacgacgucgucaucaccgugcccuucgacuucggggaaaaacagaagaacgccuugggggaggccgcccgcgccgccggguucaacguccucaggcucauccaugaacccagcgccgccuuguuggccuacgggaucgggcaggauaguccgaccgggaagucgaacauccucgucuuuaaauugggggggaccagucucagcuugucggugauggaggucaauucggggaucuacagagucuugagcacgaauaccgacgacaauauagggggggcccauuuuaccgagacgcucgcccaauacuuggccagcgaauuucagcgcaguuuuaagcacgacguccgcgggaacgccagggcgaugaugaagcucaccaauucggccgaggucgccaaacacagccucagcacgcucgggucggcgaauugcuuuuuggauagccucuacgaggggcaggacuucgacuguaacgucagucgcgcccgcuucgaguuguugugcagcccguuguucaacaaaugcaucgaggccauacgcggguugcucgaccagaacggguuuaccgccgacgacauaaauaaagucguguugugcgggggcagcagcaggauaccgaaauugcaacaauuaaucaaggacuuguuuccggccgucgaauuguugaacagcauaccgccggacgaggucauaccgaucggggccgccaucgaggccgggaucuugaucggcaaggagaauuuacucgucgaagauagcuugaugaucgaaugcagcgcgcgcgacauccucgucaaaggggucgaugagagcggggcgucgcgcuuuaccgucuuauucccgagcggcaccccgcucccggccaggcgccagcauacccuccaagcgccggggucgaucagcagcgucuguuuggaguuguacgaaagcgacggcaaaaauagcgcgaaagaagagacgaaauucgcccaagucgucuugcaagaucucgauaagaaggagaacgggcucagggacauccucgccgucuugaccaugaagcgcgacgggagccuccacgucaccuguaccgaccaagaaaccgggaagugcgaggccauaagcaucgaaaucgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5782 - RNA, 2924 nt, Artificial Sequence
  mRNA product Design3 comprising derived and/or modified sequence from Homo sapiens__NP_006635.2 __HsHSPH1 (opt10)
gggagagucccgcagucggcguccagcggcucugcuuguucgugugugugucguugcaggccuuauucaagcuuaccauguccgugguaggacucgacgucgggagccaaagcugcuacauagcgguagccagggcaggcgggauagagacgaucgccaacgaguucuccgaucgcugcacacccagcgucaucagcuuugguucuaaaaacaggacuauaggaguggccgcgaaaaaccaacaaauaacccaugcaaacaacaccgucagcaacuucaaacgauuccacggacgugccuucaacgacccguuuauacaaaaagaaaaagaaaaccuauccuacgaccuagucccccucaagaauggaggcgugggcaucaaaguuauguauaugggagaagaacacuuguucucaguagaacagauaaccgccaugcuacuaacaaaacugaaggaaaccgcagagaacagucugaagaaaccugucaccgacugcguaaucuccguacccuccuucuucaccgacgcagaacggagauccguacuagacgcagcccaaauaguaggccuaaacugccuccgcuugaugaacgauaugacggccguagcacucaacuaugggauuuacaaacaagaccucccaagccucgacgaaaaaccccgcauaguagucuucgucgacaugggacacucagcauuccagguaagcgcaugcgccuucaacaaaggaaaacucaaagucuuaggcacggcuuucgaccccuuccuaggcgggaaaaauuucgacgagaaacucgucgaacacuucugcgccgaguucaaaaccaaauacaaacucgacgcaaagagcaaaauccgagcccuccuacgcuuauaccaggaaugcgaaaagcuaaagaaauugauguccuccaacuccaccgaccuacccuuaaacaucgaauguuucaugaacgacaaggacgucagcggaaagaugaacagaucccaguucgaggagcucugcgccgaguuauuacaaaagauagaagucccccucuacagccuucucgaacagacccaccucaaaguagaagacguuucagccgucgaaaucgucggcggagcaacacgcauccccgcggucaaagaacgcaucgccaaauucuucgggaaggacauauccaccacccuaaacgcagacgaagcaguggcacgcgggugugcccuccagugcgccaucuuaagccccgcauucaaaguacgagaguucucaguaaccgaugccgucccguucccaauaagccugauauggaaccacgacagcgaggacaccgaagguguccacgaagucuucagucgaaaccacgcggccccauucucaaaaguauuaacguuccuccgacgcggacccuucgaacucgaagcauucuacagcgacccgcaaggcguaccguacccugaggcaaagauuggcagguucguaguccagaacgucuccgcacaaaaagauggcgagaaaagccgcguaaaggucaaaguccgagucaauacacacggaaucuucaccauuuccaccgccucaaugguagaaaaaguccccacagaagaaaacgagaugagcucugaagccgacauggagugccucaaccaacgcccacccgaaaaccccgacaccgacaagaacguccaacaagacaacagcgaagcaggaacccagccccaaguccaaaccgacgcacaacagaccagccagagcccacccucccccgagcucacaucagaagaaaauaagaucccagacgcagacaaggccaacgaaaagaaagucgaccagcccccggaggccaagaaacccaaaaucaaaguggucaacguagaacuccccaucgaagcaaaccuggucuggcagcuagguaaagacuuauuaaacauguacaucgaaaccgaaggcaaaaugauaaugcaagauaaacucgaaaaagaacgcaacgacgccaaaaacgcagucgaagaauacguauacgaguuccgggacaaauuaugcggcccauacgaaaaauucaucugugaacaagaccaccaaaacuuucuacguuuauuaaccgaaaccgaagacuggcucuacgaagaaggcgaagaucaagcaaaacaggcuuacgucgauaaacucgaagaacuaaugaaaaucggaacgccggucaaagugcgguuccaagaagcagaagaacgucccaaaauguucgaggaacucggacaaagacuccaacacuacgcgaaaaucgccgccgacuuccgcaacaaagacgagaaguacaaccacaucgacgaaucagaaaugaagaaaguagaaaagucggucaacgaaguaauggaauggaugaacaacguaaugaacgcccaagccaaaaagucccucgaccaagacccagucguccgagcacaagaaaucaaaaccaaaauuaaggaacucaacaauaccugcgagcccgucguaacgcaaccgaaaccaaaaauagaaucccccaaacucgaacgaacccccaacgggccgaacaucgacaagaaagaagaagaccucgaggacaaaaacaacuucggagcagaaccaccacaccaaaacggcgaaugcuacccaaacgagaaaaacagcgucaacauggaccucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5783 - RNA, 3347 nt, Artificial Sequence
  mRNA product Design3 comprising derived and/or modified sequence from Homo sapiens__NP_006380.1 __HsHYOU1 (opt10)
gggagagucccgcagucggcguccagcggcucugcuuguucgugugugugucguugcaggccuuauucaagcuuaccauggccgauaagguccgccgccaacgcccccgccgcagggugugcugggcgcucgucgccgucuugcucgccgauuuacucgccuuaucggacaccuuagccgucaugagcgucgauuuagggucggaaaguaugaaagucgcgaucgugaagccgggggucccgauggagaucgugcucaacaaagagagcagacgcaagacccccgucauagucacguuaaaggagaacgagcgcuuuuucggggauucggccgccucgauggccaucaaaaacccgaaagccaccuugagguauuuucaacauuuguuaggcaaacaagccgacaauccgcacgucgccuuguaucaagcgagguuucccgaacaugaauuaaccuuugauccgcaacgccaaaccguccauuuccaaauaucgagccaauuacaauuuagcccggaagagguccucgggauggucuugaacuacagcaggagcuuggccgaggacuucgccgaacaaccgauaaaagacgccgucauaacggucccgguguuuuuuaaucaagcggaaaggagggccgucuuacaagccgccaggauggccggguugaaggucuuacaauugauaaacgauaauacggcgaccgcguugucguacgggguguuuaggagaaaggacaucaauacgaccgcgcaaaacauaauguuuuacgauauggggagcgggucgacggucuguacgaucgucacguaucaaauggucaaaaccaaagaggccggcaugcaaccgcaauuacaaauaagaggggucggguucgauaggacguuaggcggguuagaaauggaauugagauugagggagagguuagccggcuuguuuaacgaacaaaggaaagggcaacgcgccaaagacgucagagaaaaucccagggcgauggcgaaauuauuaagggaagccaacagauugaagacgguguugucggcgaaugccgaucauauggcccaaaucgagggguuaauggacgacgucgauuuuaaagccaaggucaccagggucgaguucgaagaacucugcgccgaucucuucgaaagagucccgggcccgguccaacaagcguugcaaucggcggagaugucguuagacgaaaucgaacaagucauauuagucgggggcgcgaccagagugccgcgcguccaagaagucuuauuaaaagcggucgggaaagaagaauuaggcaaaaauauaaacgccgacgaggccgcggcgaugggcgccgucuaucaagccgccgccuugucgaaggcguucaaggucaaaccguucguggugagggacgccgucguguauccgauauuagucgaauuuacccgcgaagucgaagaagaaccgggcauccauucguuaaaacauaacaagagagucuuguuuagcagaaugggcccguauccgcagaggaaggugauaacguucaauagguauucgcacgacuuuaauuuucauauaaauuauggggauuuaggguuuuuaggcccggaggacuugagagucuucgggagucaaaacuuaacgaccgucaaauugaagggcgucggggauucguuuaaaaaauacccggauuaugaaaguaaagggauaaaagcccauuuuaauuuagacgaaucgggggucuugucguuggaucgcgucgaaagcgucuucgaaaccuuagucgaagauucggccgaggaagagagcaccuugacgaaguuggggaauacgaucaguucguuauucgggggggggacgaccccggacgcgaaagaaaacgggaccgacaccgugcaagaagaggaagaaucgccggccgaaggcucgaaagaugaaccgggcgaacaagucgaauugaaagaagaggccgaagcgccggucgaagacgggagccaaccgccgccgccggagccgaaaggggacgccacgccggaaggggagaaagcgaccgagaaggagaacggcgauaaaagcgaagcgcaaaagccgucggaaaaagccgaagccggcccggaagggguggccccggcgccggaaggggaaaaaaaacaaaaaccggcgcgcaaaagaaggauggucgaagaaauaggcgucgaauuagucgucuuagauuuaccggaucucccggaagacaaauuagcccaaagcguccaaaaguugcaagaucucaccuugagggauuuagaaaaacaagagagagagaaggccgcaaauucgcucgaggccuuuaucuucgaaacgcaagauaaauuauaucaaccggaauaucaagaggucaguaccgaagaacaaagggaagaaauaagcggcaaauugucggcggccaguacgugguuagaagacgaaggggucggggcgacgaccgucaugcucaaagaaaaauuagccgaauuacgcaaauuaugucagggcuuauucuucagagucgaagaaaggaaaaaauggccggagagauuaagcgcguuggacaacuuguugaaucacaguucgauguuuuugaaaggcgcgagauugauaccggaaauggaucaaauauuuaccgaagucgaaaugaccacccucgaaaaggugauaaacgaaacgugggcguggaaaaacgccaccuuagcggaacaagccaaauuaccggcgaccgaaaaaccgguccucuugagcaaggauaucgaggccaaaaugauggcguuagauagggaaguccaauacuuauugaacaaagcgaaauucacgaaaccgagaccgagaccgaaagauaaaaacggcacgagagccgaaccgccguugaacgcgucggcgucggaucaaggcgaaaaagugauaccgccggccgggcaaaccgaggacgccgaaccgaucagcgagccggaaaaggucgaaaccgggagugaaccgggggauaccgaaccgcucgaacucggggggccgggggccgagccggagcaaaaggagcagagcaccgggcaaaaaagaccgcucaaaaaugaugaguugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5784 - RNA, 2546 nt, Artificial Sequence
  mRNA product Design3 comprising derived and/or modified sequence from Homo sapiens__NP_005339.3 __HsHSP90AA1 (opt10)
gggagagucccgcagucggcguccagcggcucugcuuguucgugugugugucguugcaggccuuauucaagcuuaccaugccggaggagacgcaaacgcaggaucagccgauggaggaagaggagguagagacauucgcauuccaggcggagauagcacaauuaaugucguuaauaauuaacacguucuacaguaacaaggagauauucuuaagggaguuaauaucgaacucgucggacgcguuggacaaaauacgauacgaaucguuaacggacccgucgaaguuagacucggguaaggaguugcacaucaacuuaauuccgaacaagcaggaccggacguuaacgauaguagacacggguauaggaaugacgaaagcggacuugauaaacaacuuaggaacgauagcgaagucggguacuaaggcguucauggaggcauuacaggcgggugcggacauaaguaugauaggucaauucggggucggauucuacucggcauacuuagucgcagagaagguaacgguaaucacgaagcacaacgacgacgaacaauacgccugggagaguucggcgggugguaguuucacgguacgcacugacacgggugagccgauggguagggguacgaagguaauauuacacuuaaaggaggaccagacggaauacuuagaggagcgccggaucaaggagauuguuaaaaagcacucgcaauucaucggcuacccuauaacguuauucgucgagaaggagcgcgacaaggagguuagugacgacgaggcggaggagaaagaggacaaggaggaggagaaggaaaaggaggagaaggagucggaggacaagccggagauagaggacguaggaucggacgaggaggaggagaagaaggacggggacaaaaagaagaagaaaaagauaaaggagaaauacauagaccaagaggaguuaaacaagacgaagccgaucuggacaaggaacccggacgacauaacgaacgaggaguacggugaguucuacaagucguuaacaaacgacugggaggaccacuuagcggucaaacacuucaguguagaggggcaguuagaguuccgcgcguuguuauucguaccgaggcgcgcgccguucgacuuauucgagaaccggaagaagaaaaacaauauaaaguuauacguccgaaggguauucauaauggacaacugcgaggaguuaauuccggaguaccucaacuucauacgcggugucgucgacucggaagacuugccguuaaacaucucgcgagagauguuacagcagucgaagaucuuaaagguaauacgcaagaacuuagucaagaagugcuuagaguuauucacggaguuggcagaggacaaggagaauuacaaaaaauucuacgagcaguucucgaagaauauaaaguuagggauacacgaggacagucagaaccgaaaaaaguuaucagaauuauuacgauacuauacgagugcgucgggggacgaaauggucaguuugaaggacuauuguacacggaugaaggaaaaccaaaagcacauauacuacauaacgggggagacgaaggaccaaguugcgaacucggcauucgucgagcgcuuacggaagcacggguuagaggucauauacaugaucgaaccuauagacgaguauugcguacagcaauugaaggaguucgaggggaagacauuaguaaguguaacaaaggagggguuagaguugccggaggacgaggaggagaagaagaagcaggaggagaagaagacgaaguucgagaacuuaugcaagauaaugaaggacauauuagagaagaaggucgagaaggucgucgucucuaacagguugguaacgucgccgugcugcauaguaacgucgacuuacgguuggacugcgaacauggaacgaauaaugaaggcgcaggcguuaagggacaacaguacgauggguuacauggcggcaaagaagcauuuagaaaucaacccggaccacucgaucauagagacguuacgacagaaggcggaggcggacaagaacgacaagagugucaaagacuuaguaauauuauuauacgagacggcguuguuaucgaguggguucucguuagaggacccacaaacucacgcgaaccgaauauaucgcaugauaaaguugggauuaggaaucgacgaggacgacccgacggcggacgacacaucggcggccguaaccgaggagaugccgccguuagagggugacgacgauacuucgcggauggaggagguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5785 - RNA, 2522 nt, Artificial Sequence
  mRNA product Design3 comprising derived and/or modified sequence from Homo sapiens__NP_031381.2__HsHSP90AB1 (opt10)
gggagagucccgcagucggcguccagcggcucugcuuguucgugugugugucguugcaggccuuauucaagcuuaccaugccggaggagguccaucauggcgaggaagagguggagacguuugcguuucaagcggaaaucgcgcaguugaugucgcucauaaucaauacguuuuauaguaauaaggagauauuuuugcgcgaacucaucagcaaugccucggaugcguuagauaaaauccgcuaugagucguugaccgauccgagcaaguuagauagcgggaaagaacucaagaucgauauaauaccgaauccgcaggagaggaccuugacguuggucgauacggggaucgggaugaccaaggcggauuugaucaauaacuuggggaccaucgcgaaaucgggcaccaaggcguuuauggaagcguugcaggccggggcggauaucucgaugauagggcaguuuggggucggguuuuauucggccuauuugguggcggagaaagucgucgucauaaccaagcauaaugaugaugagcaguaugcgugggagucgucggcggggggcucguuuaccgugcgcgccgaucauggggagccgaucgggaggggcaccaaggucauauugcauuugaaagaggaucagacggaguaucucgaggaaaggcgcgugaaagagguggugaagaagcauucgcaauuuauaggguauccgaucacguuguauuuagagaaggaacgcgagaaagagaucucggaugaugaagcggaagaggagaagggggagaaggaggaggaggauaaggaugaugaggagaaaccgaaaauagaggaugucgggucggaugaggaggaugauagcgggaaagauaaaaagaagaagaccaagaagauaaaggaaaaguauauagaucaggaggaauuaaauaagaccaagccgauauggacgcgcaauccggacgauauaacccaggaggaguauggcgaguuuuauaagagcuugaccaaugauugggaagaucauuuggccgucaaacauuuuucggucgaggggcaguuggaguuucgcgccuuguuguuuauaccgcgccgcgccccguuugauuuauuugagaauaaaaagaagaagaauaauaucaaauuguaugugaggaggguguuuaucauggauagcugugaugaguuaauaccggaguauuugaauuuuauaagaggggucgucgauagugaggauuugccguugaauauaucgagggagauguugcagcaaucgaaaaucuuaaaggucauacgcaagaauauagucaagaaauguuuggaguuguuuucggagcucgccgaagacaaggagaauuauaaaaaguuuuaugaggcguuuucgaaaaauuugaaguuagggauccaugaggauucgacgaacaggcgcagguugucggaguuguugcgcuaucauaccucgcaaucgggggaugaaaugaccucguugagugaguaugucucgagaaugaaggagacccagaaaagcaucuauuauauaacgggggaaucgaaagagcaggucgccaauagcgccuuuguggagagggucaggaaaaggggguuugagguggucuauaugaccgaaccgauagaugaauauugcguccagcaauugaaggaguuugaugggaagucguuggugagcgucacgaaggagggguuggagcucccggaggaugaggaggaaaaaaagaagauggaggagagcaaggcgaaguuugaaaaucucuguaaauuaaugaaggaaauauuggauaagaaagucgagaaagugaccauaagcaauagauuagucucgagcccguguuguauagugaccucgaccuauggguggaccgccaauauggagaggaucaugaaggcccaggcguugcgcgauaauagcacgaugggcuauaugauggcgaaaaagcauuuggagaucaauccggaucauccgaucgucgagaccuugcgccagaaagcggaggccgauaagaaugauaaggcggucaaggauuuggucguguuauuguuugagaccgcguuguugagcucgggguucagcuuagaagauccgcagacgcauucgaaucgcauauauaggaugaucaaauugggguuagggaucgaugaagaugaggucgcggccgaggaaccgaaugccgccgugccggaugagauacccccguuagagggcgaugaagaugccagccgcauggaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5786 - RNA, 2759 nt, Artificial Sequence
  mRNA product Design3 comprising derived and/or modified sequence from Homo sapiens__NP_003290.1__HsHSP90B1 (opt10)
gggagagucccgcagucggcguccagcggcucugcuuguucgugugugugucguugcaggccuuauucaagcuuaccaugcgcgcguugugggucuuggguuuguguugugucuuguugacauuugggagcgugagggccgaugaugaaguggauguagaugggaccguggaggaagauuuggggaagucgagggaggggucgagaaccgacgaugaagugguacaaagggaagaggaagccauccaauuggacggguugaaugcgucgcaaaucagggaauugagagaaaaaucggagaaauucgcguuucaggcggaggugaaucgcaugaugaaguugauuauaaauaguuuguauaagaacaaggaaaucuuuuuaagagaguugauaaguaaugcgucggacgcgcucgacaaaaucagguugauaucguuaaccgaugagaacgcgcucucgggcaaugaagaguugacggucaagaucaaaugugauaaagaaaaaaauuuauugcacgucaccgauacaggggucgggaugacgagggaggaauuggugaagaauuuggggacgaucgcgaaaucggggaccucggaauuuuugaauaagaugaccgaagcgcaagaggaugggcaaagcaccucggaauugaucgggcaauuuggcgucggcuuuuauucggccuuuuuggucgccgauaaagucaucgugaccucgaagcauaauaaugacacgcaacauauuugggaaagcgauucgaaugaguucucggucauagccgaucccagagggaauaccuuggggcgcgggacgacgauaaccuuggucuugaaagaggaagccagcgauuauuuggaguuagauaccauaaagaauuuggucaaaaaguacucgcaauuuauuaauuuucccaucuauguguggucgagcaaaaccgagaccgucgaagaaccuauggaagaagaagaagccgcgaaggaggaaaaggaggagagcgacgaugaggccgccguggaagaggaggaagaggaaaagaaaccgaaaacgaaaaaggucgaaaagacggucugggauugggaguugaugaacgauauuaagccgaucuggcaaaggcccucgaaggagguggaagaggaugaauauaaggcguuuuauaaaucguuuucgaaagagucggacgauccuauggcguacauccauuucaccgcggagggggaagucaccuuuaagucgauauuguuugugccuaccucggcgccgcgcggguuguucgaugaguauggcucgaaaaaaucggauuauauaaaguuguauguaaggagagucuuuauuacggaugauuuucaugauaugaugccgaaauauuuaaauuucgugaaaggggucgucgacagcgacgauuuaccguugaacgucucgcgcgaaaccuugcaacaacauaaguuauugaaagucaucaggaaaaaauuggugcgcaagaccuuggauaugauaaaaaaaaucgccgacgacaaauauaacgauaccuuuuggaaggaauuugggacaaauauuaaguugggggucauagaggaucauucgaacaggacccgcuuggccaaguuguugcgcuuucaaucgucgcaccauccgaccgauaucaccucguuagaucaauacgucgagaggaugaaagagaagcaagauaagauauauuuuauggccgggaguucgaggaaggaagccgagucgucgccguucgucgaaagguuguugaaaaaaggguacgaggugauauaucucacggagccggucgaugaguauuguauacaagcguugccggaauuugaugggaaacgcuuucaaaacguggccaaagagggggucaaauuugaugagucggaaaaaaccaaagaaagccgcgaggccguggaaaaggaauuugaaccguuauugaauuggaugaaggauaaggcauugaaagauaaaaucgagaaagccgucgucagccaaagauuaacggaaucgccgugcgcguugguggcaucgcaauauggguggucggguaauauggaacgcauaaugaaagcccaagcguaucaaaccgggaaagauauaucgacgaauuauuaugcgucgcaaaaaaaaaccuuugagauaaauccgcgccaucccuugauucgcgauauguugaggcgcauaaaagaggaugaagacgauaaaacggucuuggauuuggcaguagucuuguuugagaccgcgaccuugcgcucgggguauuuauugccggauaccaaggcguauggggauaggauagagaggauguugcgcuugucguugaauaucgauccggacgccaaagucgaggaagaaccggaagaagaaccggaggaaaccgccgaagauacgacggaagauaccgaacaagaugaagacgaagaaauggacguagggaccgaugaggaagaggagacggccaaagagagcacggccgagaaagaugaguugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5787 - RNA, 2462 nt, Artificial Sequence
  mRNA product Design3 comprising derived and/or modified sequence from Homo sapiens__NP_057376.2__HsTRAP1 (opt10)
gggagagucccgcagucggcguccagcggcucugcuuguucgugugugugucguugcaggccuuauucaagcuuaccauggcgagggagcucagggcguuguuguugugggggaggagguugaggccguuguugagggcgccggccuuggcggccgugccgggggggaagccgaucuuguguccgaggcgcaccaccgcccaguuggggccgaggaggaauccggcguggagcuugcaagcggggagguuguuuaguacccagacggcggaggauaaggaggagccguugcauucgaucauaucgucgacggaaaguguccaggggucgacgaguaagcaugaauuucaagcggagacgaaaaaguuguuggauauagucgcgaggucguuguauagugagaaggagguguuuauaagggaguugauaagcaaugccagugaugccuuggagaaguugaggcauaaguuggucagcgaugggcaggccuugccggagauggagauccacuugcagacgaaugccgagaaggggacgaucaccauccaggauaccgggaucgggaugacccaagaagaguuggugagcaauuuggggaccaucgcgaggucggggucgaaggcguuuuuggaugcguugcagaaucaggcggaggcgaguaguaagauaauagggcaauuuggggucggguuuuacagugcguuuauggucgccgauaggguggaggucuacagcaggagcgccgcgccggggaguuugggguaucagugguugagugaugggucgggggucuuugagaucgccgaggcgagcggggugaggaccgggacgaagauaauaauccauuugaagucggauuguaaggaguucucgagcgaggcgagggugagggauguggugacgaaguacagcaacuuugugagcuucccguuguacuugaaugggcgcaggaugaauaccuugcaggcgauauggaugauggauccgaaggaugugagggaguggcaacacgaggaauuuuauagguaugucgcccaggcccaugauaagccgagguauacguugcauuauaagaccgaugcgccguugaauauaaggaguauauuuuauguccccgauaugaagccgucgauguuugaugucaguagggaguuggggagcagcgucgccuuguauagccgcaagguguugauccagaccaaggcgacggauauauugccgaagugguugagguuuauacgcggggugguggauucggaggauauaccguugaauuugagcagggaguuguugcaggagagugcgcucauaaggaaguugagggaugucuugcagcaaagguugaucaaguuuuuuauagaccagaguaaaaaggacgccgagaaguaugcgaaguuuuuugaggauuauggguuguuuaugagagaggggauagucaccgccacggaacaggaagugaaggaagauaucgccaaguuguugcgcuaugaaaguucggcguugccgagcgggcaguugaccucguugucggaguaugcgagcaggaugcgcgccgggacgaggaauauauauuauuugugugcgccgaauaggcauuuggccgagcauagcccguauuaugaagcgaugaagaaaaaggauacggagguguuauuuuguuucgagcaguuugaugaguuaacguuguugcauuugcgcgaauuugauaagaaaaaguugauaucgguggaaaccgauauaguggucgaucauuauaaggaggagaaguuugaagauaggucgccggcggccgaguguuugagcgagaaggagacggaggaguugauggcguggaugagaaauguguuggggagucgcgucacgaaugucaaggugaccuugcgcuuggauacgcauccggcgauggugacggucuuggagaugggggccgcgaggcauuuuuugaggaugcagcaguuggccaagacccaagaagagagggcgcaguuguugcagccgacguuggagaucaauccgaggcaugcguugaucaaaaaguugaaccaguuacgcgcgagugaaccgggguuggcgcaguuguugguggaucaaauauaugagaaugcgaugauagccgccggguuggucgaugauccgagggcgauggucgggagguugaacgaguuguuggugaaggccuuggaaaggcacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5788 - RNA, 809 nt, Artificial Sequence
  mRNA product Design3 comprising derived and/or modified sequence from Homo sapiens__NP_000609.1__HsIGF1 (opt10)
gggagagucccgcagucggcguccagcggcucugcuuguucgugugugugucguugcaggccuuauucaagcuuaccauggguaagaucucgucauuaccgacgcaguuguucaagugcugcuucugcgacuucuuaaagguaaagaugcacacgaugucgaguucccacuuauucuacuuggccuuaugcuuguugacguucaccuccucggcgaccgcagggccggagaccuugugcggcgcggaguuaguagacgcguuacaguucgucugcggugaccgagguuucuacuucaacaagccgacggguuacggguccucgucgcgccgugcaccgcagacgggcaucguugacgaaugcugcuuccguucuugcgaccuccgucgcuuagagauguacugcgcgccguugaagccggcgaagucggcccguucgguacgcgcgcagcggcacacggacaugccaaagacgcagaaagagguccacuuaaagaacgcgucgcguggaucggccggcaacaagaacuaccggaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5789 - RNA, 890 nt, Artificial Sequence
  mRNA product Design3 comprising derived and/or modified sequence from Homo sapiens__NP_000603.1__HsIGF2 (opt10)
gggagagucccgcagucggcguccagcggcucugcuuguucgugugugugucguugcaggccuuauucaagcuuaccaugggcauacccauggguaagucaauguugguguuauuaaccuucuuagccuucgccucgugcugcaucgcggccuaccguccgucagagacccuaugcggcggggagcuaguagacacgcuacaguucgugugcggcgaccggggguucuacuucucgcgccccgcgucgcgcgugucccgccguucgcgcggcaucguagaggagugcugcuuccgaucaugcgacuuggccuuauuagagaccuacugcgccaccccggccaagucggagcgagacgugucgacgccgccgaccguguuaccggacaacuucccccgguaccccgucggcaaguucuuccaguacgacacguggaagcagucgacucagagacuucgucgcggguuaccggcguuguugcgugcccgacgaggccacgugcuagccaaggaguuagaggcguuccgcgaggcgaagcggcaccgcccguuaaucgcguuacccacucaggaccccgcgcacggaggcgccccgcccgagauggcgucgaaccgaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5790 - RNA, 986 nt, Artificial Sequence
  mRNA product Design3 comprising derived and/or modified sequence from Homo sapiens__NP_000591.1__HsIL6 (opt10)
gggagagucccgcagucggcguccagcggcucugcuuguucgugugugugucguugcaggccuuauucaagcuuaccaugaacucguucaguacgucggcguucggccccgucgcguucucguuagguuuguuauuggucuuaccggcggcguucccagcgcccguuccaccgggugaggacucgaaggacguugcggcgccccaccgacagcccuugaccucguccgagcguaucgacaagcagauccgauacaucuuagacgguauaagugcguuacgcaaggagacgugcaacaaaucgaacaugugcgagaguucgaaggaggcguuagccgagaacaaccucaacuugccgaagauggcggagaaggacgggugcuuccagaguggguucaacgaggagacaugcuuaguaaagaucauaacgggccuccuugaguucgaggucuaccucgaguacuuacagaacagguucgagucaucggaggagcaggcacgcgcgguucaaaugucgacgaagguauugauccaguuccuccagaagaaggccaagaacuuagacgcgaucacgacgccggacccgacuaccaacgcgaguuuguuaacuaaguuacaggcgcagaaccagugguugcaggacaugaccacccacuugaucuugcggucguucaaggaguucuugcagaguucuuuaagagcguuaaggcagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5791 - RNA, 1628 nt, Artificial Sequence
  mRNA product Design3 comprising derived and/or modified sequence from Homo sapiens__NP_002183.1__HsINHBA (opt10)
gggagagucccgcagucggcguccagcggcucugcuuguucgugugugugucguugcaggccuuauucaagcuuaccaugccguuauugugguuaaggggguucuuguuagcgucgugcuggaucaucgugcguucgucgccgacgcccgggucggagggucacucggccgcaccggacugcccaaguugcgcacuugccgcguuaccgaaggacguuccgaacucgcagccggagaugguugaggccgugaaaaagcacauauugaacauguuacaccuaaagaagcgaccggacguaacgcagccgguccccaaagcggcccuauuaaacgcuauacggaaguuacacguugggaagguaggcgagaacgguuacguggagaucgaggacgacaucgggcgccgcgccgagaugaacgaguuaauggagcagacgucagagaucaucaccuucgcggagucgggcacugcgcguaagacuuugcacuucgagaucucgaaggaggguucggacuuaucggugguagagcgggccgaggugugguuauucuugaaggugccgaaggcgaaccgaacgcgaaccaaggucaccauccgauuguuccagcaacagaaacacccccaggggaguuuagacaccggggaggaggccgaggagguaggucucaagggggagcgauccgagcuccucuuaucggagaagguggucgacgcgcgaaagucuacguggcacguauucccggugucgucgucgauccagcgccuacuugaccagggcaagaguucguuggacguccgcauagcgugcgagcagugccaggagucgggcgcgucucuuguauuguuagggaagaagaagaagaaggaggaggagggugaggggaagaagaaggggggcggggagggcggggcgggcgcggacgaggagaaggagcagucucaccggccguucuuaauguuacaagcgcgucaaucggaggaccacccgcaccgacgacgccgacguggguuagagugcgacggcaaggugaacaucugcugcaagaagcaguucuucguuucauucaaggacaucgguuggaacgacuggauaauagccccgucgggguaccacgcgaacuacugcgagggcgagugcccgucccacaucgccgguacuucgggcucgucguuaucguuccacaguacgguuauaaaccauuaccguaugcguggacacucccccuucgcgaacuugaagaguugcugcgugccgaccaaguugcgucccaugucgaugcuuuacuacgacgacggccagaacauuauaaagaaggacauccagaacaugaucgucgaggaaugcggcugcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5792 - RNA, 1571 nt, Artificial Sequence
  mRNA product Design3 comprising derived and/or modified sequence from Homo sapiens__NP_002184.2__HsINHBB (opt10)
gggagagucccgcagucggcguccagcggcucugcuuguucgugugugugucguugcaggccuuauucaagcuuaccauggacgguuuaccgggacgagcuuugggugcggcuuguuuguuauuguuggcagcggguugguuaggcccggaagcguggggaucgccgacaccucccccuacuccggcggcgccaccgcccccgccaccgccggggucgccaggcgggucccaagauacuugcacaaguugcggggguuuccgacgacccgaggaauugggacgcguagacggugauuucuuggaagcuguaaagcgucauaucuuaucgcguuuacagaugcgagggcgaccgaacauaacccacgccguaccgaaggcggcgaugguuaccgcguuacgaaaguuacaugcugggaagguucgugaggacgggcguguagagaucccccauuuggacgggcacgccucgccaggggccgacgggcaagagcgagucucggagauaauuaguuucgcggagacugacggguuagcgucgucgaggguacguuuauacuucuucauaucgaacgaggguaaccaaaacuuguucguaguacaggcgaguuuaugguuauaccuuaagcuauuaccauacguuuuagagaaggggucgcgucgaaaaguaaggguaaagguauacuuccaagagcaaggucacggcgaccgauggaacaugguagagaagcggguugaccuuaagcgaaguggauggcacacguucccguuaacugaggcaauacaggcauuauucgagcguggagagcgccgcuuaaacuuagacguacaaugcgacucgugccaggaguuggcagucgucccaguauucguagaccccggggaggagagucaucgaccguucguaguaguacaggcgcgcuuaggugacucgcgacaccgaauccggaagcgugguuuagagugcgacgguaggacgaacuugugcugccgacagcaguuuuuuauagacuuuagguugaucggguggaacgacuggauaauugcgccgacaggauacuacgguaacuauugcgaaggaaguugcccggcguacuuagcgggggugccagguucggcaucgucguuccacacugcgguaguuaaccaguaccgaaugcgaggauugaauccggggacaguaaacucgugcugcaucccgacgaaguuaaguacgaugucgauguuauacuucgacgacgaguacaacauaguaaagcgcgacgucccgaacaugaucguagaagagugcgguugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5793 - RNA, 3806 nt, Artificial Sequence
  mRNA product Design3 comprising derived and/or modified sequence from Homo sapiens__NP_000623.2__HsITGAM (opt10)
gggagagucccgcagucggcguccagcggcucugcuuguucgugugugugucguugcaggccuuauucaagcuuaccauggcguugaggguccucuuauugaccgccuugaccuuaugccauggguuuaauuuggauacggagaacgccaugacguuucaggagaaugccaggggguuugggcagagcgucgugcaguugcaggggagcagggucguggugggggcgccgcaggaaaucguggccgccaaucagagggggagcuuguaucagugugauuauagcacgggcagcugugagccgauacgcuuacaggugccgguggaggccgugaauaugucguuaggguugucguuggcggcgaccacgagcccgccgcaguugcucgccugugggccgacggugcaccaaacguguagcgagaauacguaugucaagggguuguguuucuuguucggcaguaauuugaggcaacaaccgcagaaguuuccggaggcguugagggggugcccccaggaggauucggauaucgcguucuugaucgaugggagugggaguaucaucccgcaugauuuuaggagaaugaaagaguucgugagcaccgucauggagcaguugaaaaagaguaagaccuuguuuaguuuaaugcaguauucggaagaauuucgcauacauuuuacguuuaaggaauuucaaaauaauccgaauccgaggagcuuagucaagccgaucacccaguuguuggggcgcacccauaccgcgaccgggauacgcaaaguggucagggaguuguuuaauaucaccaacggggccaggaagaaugcguuuaagauauuggucgugaucacggauggggagaaguuuggcgauccgcucggguaugaggaugucauaccggaggccgaucgcgaaggggucauaagguaugugauaggggucggcgaugcguuuaggucggagaagaguaggcaagaguugaauaccaucgcgaguaagcccccgagggaucauguguuucaggugaauaauuuugaggcguugaagacgauacagaaucaguugagggaaaagaucuuugcgaucgaggggacgcagacggggucgaguucgaguuuugagcacgagaugagucaggagggguuuucggcggccauaacgaguaaugggccguuguugagcacgguggggagcuaugauugggccggggggguguuuuuguauacgaguaaagagaagaguaccuuuauaaauaugacgcgcguggacagcgauaugaaugaugccuacuugggguaugcggccgccauaaucuugaggaaucgcguccagagcuugguccucggggcgccgagguaucagcauauaggguuggucgccauguuuaggcagaauacgggcaugugggagucgaaugccaaugugaaagggacgcagauaggggccuauuuuggggccagcuuguguagcgucgauguggauagcaaugggucgaccgacuuggucuugauaggggccccgcauuauuacgaacaaaccaggggggggcaggucagcgugugcccguugccgagggggagggcgagguggcagugugaugccgucuuguacggggagcaggggcagccgugggggcgcuuuggggcggccuugacgguguugggggaugugaauggggauaaguugacggaugucgccauaggggccccgggggaagaggauaauaggggggccgucuauuuguuucaugggacgagugggucggggauaagcccgagucauagccagaggaucgcggggagcaaguuaaguccgcgcuuacaguauuuuggccagucguugaguggggggcaggauuugaccauggauggguuggucgacuuaaccgucggggcccagggccacgucuuguuguugaggagucagccggucuugagggugaaagccauaauggaauuuaacccgagagagguggccaggaauguguuugaguguaaugaucaggucgugaaagggaaggaggcgggggaggugcgcgucugcuuacauguccagaaaucgaccagggacagguuaagggaggggcagauacaaagugucgugacguaugauuuggcguuggauagugggcgcccgcauucgagggcgguguuuaaugagacgaagaacagcacgaggagacagacgcaagucuugggguugacgcagaccugugaaaccuugaaguugcaguuaccgaauugcauagaggauccggugagcccgauagucuugagguugaacuucaguuugguggggaccccguugagcgccuuugggaauuugaggccgguguuggcggaggaugcgcagagguuguuuacggcguuguuuccguuugagaaaaauugugggaaugauaauaucugccaggaugauuugucgauaacguuuagcuuuaugagcuuggauuguuuggucgucggggggccgagggaguucaaugugaccgugacgguccgcaaugauggggaagacaguuaucgcacccaggucaccuuuuuuuuucccuuggauuugagcuauaggaaggugagcacguugcagaaucagaggagccagaggagcuggcgcuuggccugcgagagcgcgagcagcaccgaggucucgggggcguuaaagagcacgaguugcaguaucaaucauccgauauuuccggaaaauucggaggugaccuuuaauaucaccuuugaugucgauagcaaggccagcuuggggaauaaguugcucuuaaaggcgaaugugacgucggagaauaauaugccgcgcaccaauaagaccgaauuucaguuggaguugccggugaaauacgcggucuauaugguggugacgucgcauggggucaguaccaaguauuugaauuucacggcgucggagaauaccagucgcgucaugcagcaucaguaucaagucaguaauuuggggcagaggucguugccgauaaguuuggucuuuuuggucccggugcgcuugaaucaaaccgucaucugggauaggccgcaggucaccuuuagcgagaauuugaguaguaccugccauaccaaggagagguugccgucgcacagugauuucuuggccgaauugaggaaggcgccggucgucaauuguagcauagccgucugucaaaggauccaaugugauaucccguuuuucggcauccaagaggaauuuaaugccaccuugaaggggaauuugucguuugauugguacauaaaaacgagccacaaucauuuguugaucgucaguaccgcggagauauuguuuaaugauucgguguuuacccucuuaccggggcagggggccuuugucaggagccaaaccgagaccaaggucgagccguuugaggugcccaaucccuugcccuugauaguggggaguagugucgggggcuuguuguuguuggcguugauaaccgccgccuuauacaaauugggguuuuuuaaaaggcaguauaaggacaugaugagugagggggggcccccgggcgcggagccgcaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5794 - RNA, 1751 nt, Artificial Sequence
  mRNA product Design3 comprising derived and/or modified sequence from Homo sapiens__NP_002415.1__HsMMP8 (opt10)
gggagagucccgcagucggcguccagcggcucugcuuguucgugugugugucguugcaggccuuauucaagcuuaccauguuuaguuuaaaaaccuugccguucuuauugcucuugcacguccaaaucaguaaagcguucccggucagcagcaaggaaaagaacaccaagaccguccaagauuauuuagagaaauuuuaucagcucccgucgaaucaauaccaaagcacccgcaaaaacgggaccaacgucauagucgagaaauugaaggagaugcaaagguucuucggccucaacgucaccggcaaaccgaacgaagagaccuuagauaugaugaagaaaccgaggugcggggucccggauucggggggguucaugcucacgccggggaauccgaaaugggagaggaccaaucucacguaucgcaucaggaauuacacgccgcaauuaagcgaagccgaagucgagcgcgccauaaaagacgcguucgaguuguggucggucgccagcccguugauauuuacgcgcauaagccaaggggaagccgacauaaauaucgccuucuaucagcgcgaccauggggauaacagcccguucgacgggccgaacgggauauuggcccacgcguuccaaccggggcaggggaucgggggggacgcccacuucgacgcggaggagaccuggacgaauacgagugccaacuauaaucucuucuuggucgccgcccacgaguucgggcacagccucggcuuggcccauaguagcgauccgggggcgcucauguacccgaauuacgccuuucgcgagacgucgaauuauagcuugccgcaggacgauauagacgggauccaagcgauauacggguugagcucgaauccgauacagccgaccgggccgucgaccccgaagccgugcgauccgucgcucaccuucgacgccauaacgaccuugaggggggagaucuuguuuuucaaggaucgcuauuuuuggcgccgccacccgcaauugcagcgcguggagaugaacuucaucagcuuguuuuggccgaguuugccgaccgggauccaagccgccuacgaggacuucgaucgcgauuugaucuuuuuguucaaggggaaucaguauugggccuuaucgggguacgacaucuuacagggguacccgaaagacaucagcaauuacggguuuccgucgucggugcaggccaucgaugccgccgucuuuuaucgcucgaagaccuauuuuuucgucaacgaucaguuuuggcgcuacgacaaucagcgccaguuuauggaaccgggguacccgaagucgaucagcggggcguucccggggaucgaaucgaaggucgacgccgucuuucaacaggagcacuuuuuucacguguuuucggggccgcgcuacuaugccuucgacuugaucgcccaacgcgucacgcgcgucgcccgcgggaacaagugguugaauugccgcuacgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5795 - RNA, 2471 nt, Artificial Sequence
  mRNA product Design3 comprising derived and/or modified sequence from Homo sapiens__NP_004985.2__HsMMP9 (opt10)
gggagagucccgcagucggcguccagcggcucugcuuguucgugugugugucguugcaggccuuauucaagcuuaccaugucguuauggcaaccuuugguauugguauuauuggucuuagggugcugcuucgcagcgccgcgucagcgacagucgacauuagucuuguucccgggugacuuacgaaccaacuuaacugaucggcaauuagcugaagaguauuuauacagguacggcuacacgcgcguagcggagaugaggggggagucuaagaguuuaggcccagcauuacucuuguugcagaaacaguuaucguuacccgaaacgggggaauuagacucggcgacacucaaggcgaugcgcacuccucguugcggaguacccgacuugggacgauuucagacauucgagggugauuugaaguggcaccaccacaacauaacguacuggauccagaacuacucugaggacuuaccucgugcaguaauagacgacgcuuucgcacgagcguucgcuuuauggucggccguuacacccuugacguuuacgcgagucuauucgcgcgacgccgacauaguaauacaguucgggguagccgagcacggugacggcuacccauucgacgguaaggacgguuuauuagcgcacgcguucccgccggggccggguauccagggcgacgcgcacuucgacgacgacgaauuauggucuuuagggaaagggguaguuguaccuacgcguuucgguaacgcggacggugccgcaugccauuucccguucauauucgaggggcgaucauauagugcgugcacuacggacggacggucggacggguuacccugguguucgacuacugcgaacuacgacacggacgaccgauucgguuucugcccgucggagcguuuauacacgcaagacgguaacgcggacggcaagccuugccaguucccuuucauauuccagggacagucguacucggcaugcacaaccgacgggcggucggacggguaccgguggugcgcgacuacggcgaacuacgaucgcgacaaguuauucggguucugcccaacacgggcagacucuaccguaaugggagggaacagugccggagaguugugcguauuccccuucacguucuugggaaaagaguacucaacaugcacuucggaaggccggggugacggucgauuguggugcgccacuacgaguaacuucgacucggacaaaaagugggguuucuguccugaccagggcuauucguuauucuuaguagcagcacacgaguucgggcacgcauuaggauuggaccacaguaguguacccgaagcauugauguauccgauguaccgauuuacggaagguccgccguuacacaaggacgacguaaacgguauccgacacuuauacggcccacggccggagccggaaccgcgcccaccgaccacaacgacuccacagcccacugcaccgcccacaguauguccuacggguccuccgacaguacacccgucggagcgaccgacggcaggucccacuggaccgccgagugcagggccgacggggccgccgaccgcagguccgucgacggcgacaacggucccguuaucgcccguagacgacgcgugcaacguuaacauauucgacgcaauagcagagauagguaaccaguuauacuuauucaaggacggcaaguacuggcgcuuuucggaggggcgaggaagucgaccccaggggccguucuuaaucgcggacaaguggccggcauuaccucgaaaguuagauucaguauucgaggagcgauuaaguaagaaauuauucuucuucucggguaggcaaguauggguauauacgggugccuccguauuagggccccggaggcucgacaaguuggggcucggugcugacgucgcgcagguaacgggugcuuuacgcucgggucgaggaaagauguuauuauucaguggucgccgauuauggcguuucgacguaaaggcacagauggucgacccucgaucggcgucggaggucgaccguauguucccggguguaccguuagacacacacgacguauuccaguaccgcgaaaaggcuuacuucugccaggauagguucuacuggcgagucucgucgaggucggaauuaaaucaaguagaccagguaggguaugucacguacgacaucuuacagugcccggaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5796 - RNA, 1763 nt, Artificial Sequence
  mRNA product Design3 comprising derived and/or modified sequence from Homo sapiens__NP_002418.1__HsMMP13 (opt10)
gggagagucccgcagucggcguccagcggcucugcuuguucgugugugugucguugcaggccuuauucaagcuuaccaugcacccgggcguguuagccgcguuuuuguuucucucguggacccacugcagagcguuaccguugccgucggggggggacgaggacgaccucagcgaagaggauuugcaauucgccgaaagguauuuacgcagcuauuaucacccgaccaacuuggccgggauauuaaaagaaaacgccgccucgaguaugaccgaacgcuugagggagaugcaaaguuuuuuugggcucgaagucaccgggaaguuggaugacaauacgcucgacgugaugaagaaaccgcgcuguggcgucccggacgucggggaguauaacgucuuuccgaggaccuugaaguggaguaagaugaaccucacguaucgcaucgucaacuauacgccggacaugacccacagcgagguggagaaagccuuuaagaaggcguuuaaggucuggagugacgucaccccguuaaacuucacgcgcuugcaugacgggaucgccgauauaaugauuagcuucgggaucaaagaacacggggauuuuuauccguucgacggcccgagcggguuauuagcccacgccuucccgccgggcccgaacuacgggggggacgcgcacuucgacgacgacgagacguggaccucgucgaguaagggguauaaucucuucuuggucgccgcccacgaauuugggcauagucucggguuggaucauaguaaagauccgggggccuugauguucccgauauauacguauacggggaagucgcauuucauguugccggacgaugacguccagggcauacaaaguuuguacgggccgggggacgaggauccgaauccgaagcacccgaagaccccggauaagugcgauccgagucucaguuuggacgcgaucacgucguugaggggggagaccaugauauucaaggaucgcuuuuuuuggagguuacacccgcaacaagucgacgccgaauuauuccucaccaagagcuucuggccggaguugccgaauaggaucgacgccgccuacgaacauccgagccacgauuugauauuuauauuucgcgggcgcaaguucugggccuugaacggguacgauaucuuagagggguacccgaagaagaucagcgaguuaggguugccgaaggaggucaaaaaaaucucggccgccguccauuucgaagacaccgggaaaaccuuguuauuuagcgggaaucaaguguggcgcuacgacgacaccaaucacaucauggacaaggauuacccccgcuugaucgaggaggauuuuccggggaucggggacaaggucgacgccguguacgaaaagaacggguacauauacuucuuuaaugggccgauccaauucgaguauucgauauggucgaauaggaucgucagggugaugccggccaacaguauccucuggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5797 - RNA, 1415 nt, Artificial Sequence
  mRNA product Design3 comprising derived and/or modified sequence from Homo sapiens__NP_001286.1__HsCCR1 (opt10)
gggagagucccgcagucggcguccagcggcucugcuuguucgugugugugucguugcaggccuuauucaagcuuaccauggaaaccccgaacaccaccgaagauuacgacaccacaaccgaguucgacuacggcgacgccacccccugccaaaaagucaacgaacgcgccuucggcgcccaacuccucccaccccuuuacucccucgucuucgucaucggccucgucggcaauauccucguaguccucguccucguccaauacaaacgacucaaaaacaugaccuccaucuacuuacucaacuuagccaucuccgaccuccucuuccucuucacccuccccuucuggauagacuacaaacucaaagacgacugggucuucggcgacgccaugugcaaaauccucucgggcuucuacuacacaggacucuacuccgaaaucuucuucaucauccucuuaacuaucgaccgcuaccuagccaucguccacgccgucuucgcacuacgcgcccgcaccguaaccuucggcgucaucaccucaaucaucaucugggcccucgccauccucgccuccaugcccggccucuacuucucaaaaacccaaugggaguucacacaccacacaugcucacuccacuucccccacgaauccuuacgcgaauggaaacucuuccaagcccucaaacucaaccuauucggccuaguccucccacuacucgucaugaucaucugcuacacaggcaucaucaaaauacuccuccgccgccccaacgaaaagaaauccaaagcaguccgccucaucuuugucauaaugauaaucuucuuccuauucuggacccccuacaaccucaccauccucaucucaguauuccaagacuuccucuucacccaugaaugcgaacaaucacgccacuuagaccucgccguccaagucaccgaggucauugccuacacccacugcugcgucaacccaguaaucuacgccuucgucggcgaacgcuuccgcaaauaccuccgucaacuauuccaccgacgcgucgccguacaccucgucaaauggcuccccuuccuaucugucgaccgauuagaacgcgucuccuccacaagcccaagcaccggcgaacacgaacucuccgccggcuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5798 - RNA, 983 nt, Artificial Sequence
  mRNA product Design3 comprising derived and/or modified sequence from Homo sapiens__NP_002598.4__HsPDGFA (opt10)
gggagagucccgcagucggcguccagcggcucugcuuguucgugugugugucguugcaggccuuauucaagcuuaccaugcgaacauuagcaugcuuguuguuauuagguugcggguacuuagcgcacguguuagcagaggaggcagagaucccgcgugagguuaucgagcgcuuggcacgaucgcagauccacaguauccgagacuuacagcgguuguuggagaucgacucagucggcucggaggacucguuagacacgaguuuacgagcgcacggggugcacgccacgaagcacguaccggagaagcgcccguugccgauacgucgcaagcgaucgaucgaggaggcggugcccgcgguuugcaagacgcgaaccgucaucuacgagaucccacgaucgcagguagacccuaccucggcuaacuucuuaauauggccuccaugcguagaggucaagcguugcacggggugcugcaacacaucgucgguuaagugccagccgucgcgagugcaccaccguucgguaaagguggccaagguugaguacguacgaaagaagcccaagcuaaaggagguucagguucgauuggaggagcacuuagagugcgcuugcgccacgacgaguuugaaccccgacuaccgugaggaggacacggggcgaccgcgcgagucgggcaagaagcgaaagcgaaagcgguugaagccgacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5799 - RNA, 1073 nt, Artificial Sequence
  mRNA product Design3 comprising derived and/or modified sequence from Homo sapiens__NP_002599.1__HsPDGFB (opt10)
gggagagucccgcagucggcguccagcggcucugcuuguucgugugugugucguugcaggccuuauucaagcuuaccaugaaccguugcugggcccuuuucuugucguuaugcugcuacuugcgcuuggugucggccgagggugauccgauaccggaggagcuguacgagaugcuaucugaccacaguauaaggucauucgacgacuugcagcgauuauuacacggggacccgggugaagaggacggggcggaguuagacuuaaacaugacgcgcucgcacucggguggggaguuggagucguuagcgcgggggcggcgaucguuagggucguugacgaucgcggagccugcgaugaucgcggagugcaagacgcguacggaggucuucgagauaucgcgacguuuaaucgaccgaaccaacgcaaacuucuuaguauggcccccuugcgucgagguacagaggugcaguggaugcugcaacaaccgaaacguccagugcaggccgacgcagguucaguugcguccgguacaaguccguaagaucgagaucguccguaagaagccgauauucaagaaggcuacgguaaccuuagaggaccaucucgccugcaagugcgagacugucgccgcggcgaggccgguaacucggucgcccggugggagucaggagcagcgugcgaagacgccgcagacgcgaguuaccauaaggaccguacgugugcgucguccgccgaaaggaaagcaccgaaaguucaagcacacgcacgacaagacugccuuaaaggagacguuaggugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5800 - RNA, 1385 nt, Artificial Sequence
  mRNA product Design3 comprising derived and/or modified sequence from Homo sapiens__NP_057289.1__HsPDGFC (opt10)
gggagagucccgcagucggcguccagcggcucugcuuguucgugugugugucguugcaggccuuauucaagcuuaccaugucguuauucggcuuguuauuauugacgagugcguuagcagggcagcggcaagguacacaggcagagucgaaccucucgucgaaguuccaguucucgucgaacaaggagcagaacggugugcaggacccacagcacgagcguaucaucacgguuucgacaaacgggucgauacacucgccgcguuucccacacacguacccgcgaaacacuguguuagucuggcgucucguugccgucgaggagaacguuuggauccaguuaacuuucgacgagagguucgguuuagaggacccggaggacgacaucugcaaguacgacuucguugagguagaggagccuucagacgguacgaucuugggacgauggugcgggucggggaccguucccgggaagcagauaucgaaggggaaccagauacgaauccgauucgucucggacgaguacuucccgucggagccggguuucugcauacacuacaacauaguaaugccgcaguucacggaggccguuucgccgucugucuuaccgcccucggcguuaccguuagacuuacucaacaacgcgaucacggcguucucuacguuagaggacuuaauacguuacuuagagccggagcgauggcaauuagacuuggaggacuuguaccgccccaccuggcaguuacucgguaaggcauucguauucgggcgaaagagucgaguaguagacuuaaauuuauuaaccgaggagguucgacuauacucuugcacuccccgcaacuucucgguuucgauccgagaggagcuuaagcgcacggacacgauauucuggccggggugcuuauuggucaagaggugcggggguaacugcgcgugcugccuucacaacugcaacgagugccagugcgugccgucgaaggucacaaagaaguaccacgaggucuuacaacuucgccccaagacgggcgugcgagguuuacacaagagucuaacugacguagcgcucgagcaccacgaggagugcgacugcgucugcagggggucgaccggggggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5801 - RNA, 1442 nt, Artificial Sequence
  mRNA product Design3 comprising derived and/or modified sequence from Homo sapiens__NP_149126.1__HsPDGFD (opt10)
gggagagucccgcagucggcguccagcggcucugcuuguucgugugugugucguugcaggccuuauucaagcuuaccaugcaccgacuaaucuucguauacaccuugauaugcgccaacuucugcuccugccgagacacgucggccacuccccagucggcuaguauaaaggcccuucguaacgcgaacuugcgucgggacgaccuuuacaggagggacgagacuauccaggucaagggcaacggauacguccaaucgccccgguuccccaacaguuacccgcggaacuuacuuuugaccuggcguuuacacucgcaggagaacacgaggauccaauuaguuuucgacaaccaguucggccucgaggaggccgagaacgacauaugccgauacgacuucguagagguagaggacaucagugagaccucgacgauaaucagggggcgguggugcggccacaaggagguacccccucgaaucaagagucgaaccaaccagaucaagauaaccuucaagucggacgacuacuucguagcaaagccgggguucaagauauacuacucgcucuuagaggacuuccagccggcggccgcgucggagacaaacugggagucgguaacgucgucgauaucgggugugucguacaacucacccucggucaccgacccgaccuugauagccgacgcguuagacaagaagaucgccgaguucgacacgguagaggacuuguugaaguacuucaacccggagucguggcaggaggacuuagagaacauguacuuagacacgccgagguacagggggcggucguaccacgaccgcaagucgaagguggacuuagaccgacuuaacgacgacgcgaagcgauacucgugcacaccucgaaacuacaguguaaacaucagggaggaguuaaaguuagccaacgucguauucuucccgcggugcuuauuaguucagcguugcgggggcaacugcgguugcgggacggugaacuggcgaucuugcacgugcaacucggguaagaccguaaagaaguaccacgagguccuucaguucgagcccgggcacauaaagcgucgcggccgugcgaagaccauggcgcucguggacauucaacucgaccaccacgagcguugcgacugcaucugcucgucgcgaccuccgcguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5802 - RNA, 1025 nt, Artificial Sequence
  mRNA product Design3 comprising derived and/or modified sequence from Homo sapiens__NP_003946.3__HsSOCS3 (opt10)
gggagagucccgcagucggcguccagcggcucugcuuguucgugugugugucguugcaggccuuauucaagcuuaccaugguaacgcacucgaaguucccggcggcggguaugaguaggccguuagacacaucgcuucguuuaaagacauucucgucgaagagugaauaccagcucguugucaacgcgguccggaaguugcaagaaucagguuucuauuggucggcgguaacggggggggaggcaaauuuauuauugucggcggagccagcggggacauucuuaauccgugacucgucugaccagcggcacuuuuuuacauuaucagugaagacacaaucggguacgaagaaccuucgaauacagugcgagggcggaaguuucucguugcagagugacccgcgaucuacacagccggucccucgauucgacugcguauuaaaguugguucaccauuacaugcccccaccgggggcuccgaguuucccgucaccgccgacggagccgaguucggagguaccggagcagccaucggcgcagccuuuaccggguucgccgccucgacgcgcguacuacauauacucggggggugaaaagauuccacucguauuaucgaggccuuuaucgucgaacguagcgacacuccaacacuugugccgcaagaccguuaacggacauuuagacucguacgagaaggucacgcaacucccaggcccgaucagggaguucuuggaccaguacgacgcuccauuaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5803 - RNA, 830 nt, Artificial Sequence
  mRNA product Design3 comprising derived and/or modified sequence from Homo sapiens__NP_003227.1__HsTGFA (opt10)
gggagagucccgcagucggcguccagcggcucugcuuguucgugugugugucguugcaggccuuauucaagcuuaccauggugccgagcgccgggcaauuggcguuauuugccuuagggaucguccucgccgccugucaagcgcucgaaaauucgaccagucccuuaucggccgaucccccggucgccgccgccgucgucagucacuucaacgauuguccggacagucauacccaauuuuguuuucacgggacgugucgcuuccucguccaagaagauaaaccggccugcgugugucacagcggcuaugucggggccaggugcgaacacgccgauuuguuagcggucgucgccgcgucgcaaaaaaaacaagcgauaacggcgcucgucgucgugaguauagucgcguuagccguguugauaauaaccugcgucuuaauccauuguugucaagugaggaagcauugcgaaugguguagagcguugauauguagacaugaaaaaccgucggcguuguuaaaagggcgcacggccuguugucauagcgagaccgucgugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5804 - RNA, 1520 nt, Artificial Sequence
  mRNA product Design3 comprising derived and/or modified sequence from Homo sapiens__NP_000651.3__HsTGFB1 (opt10)
gggagagucccgcagucggcguccagcggcucugcuuguucgugugugugucguugcaggccuuauucaagcuuaccaugcccccgucugguuuacgauuauuacccuuauuguuacccuuauugugguuauuaguauugacccccgggcgaccggccgccggcuuaaguacgugcaagaccaucgacauggaguuaguaaagcggaagcgaauagaggcgauacgagggcagaucuuaucgaaguuacgauuagccaguccgcccucgcagggcgagguaccgcccgggcccuugcccgaggccguauuagcguuauacaacaguacccgagaccgaguagcgggugagucugcggagcccgagcccgagcccgaggccgacuacuacgccaaggagguaacacgaguauugaugguagagacccacaacgagaucuacgacaaguucaagcagaguacgcacucuaucuacauguucuucaacacgagugaguuacgagaggcgguucccgagcccguauuauuaagucgagcggaguuacgauuauugcgauuaaaguuaaagguagagcagcacguagaguuauaccagaaguacaguaacaacucuuggcgauacuuaucaaaccguuuauuagcgccgucugacagucccgagugguuaucuuucgacguaacggggguaguacgacagugguuaagucgugggggcgagauagagggguuccgauugucagcgcacugcaguugcgacucucgggacaacacguugcagguagacaucaacggcuucacgacggggcgacgaggcgacuuagccaccauacacggcaugaaccgacccuucuuauuauuaauggccacgcccuuagagcgugcgcagcacuuacagucuagucgacaccgacgagccuuagacaccaacuacugcuucaguucgaccgagaagaacugcugcguacgacaguuauacaucgacuuccgaaaggacuuaggguggaaguggauacacgagccgaagggcuaccacgcgaacuucugcuuagggcccugccccuacaucuggucguuagacacgcaguacaguaagguauuagccuuauacaaccagcacaaccccggcgccucggcggccccgugcugcguaccgcaggcguuggagcccuuacccauaguauacuacguaggccguaagccgaagguagagcaguuaaguaacaugauaguacgaucgugcaagugcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5805 - RNA, 1592 nt, Artificial Sequence
  mRNA product Design3 comprising derived and/or modified sequence from Homo sapiens__NP_003229.1__HsTGFB2 (opt10)
gggagagucccgcagucggcguccagcggcucugcuuguucgugugugugucguugcaggccuuauucaagcuuaccaugcacuacugcguauuaucugcguucuugauauuacacuuaguuaccguggcauugaguuuauccacuugcaguacguuagacauggaccaguucaugcgaaagcgaauagaggcuauaaggggucagauuuugucgaagcucaaguuaacgucuccuccggaggacuaccccgagccggaagagguaccgccggagguaaucaguauauacaacucgacgcgagaccuuuuacaggaaaaggcaucgcgacgcgcagcggcgugcgagagggagcguucggacgaggaguacuacgcgaaggaaguauacaagaucgacaugccuccguucuucccgucggagaacgcgaucccaccuacguucuaucgaccguacuuccgcaucgucagguucgacguaagugcgauggagaagaacgccucuaacuuaguaaaggcggaguuucgaguauucagguuacagaacccgaaggcgcgaguucccgagcagaggaucgaguuauaccagaucuuaaagaguaaggaccuuacuucgccuacgcaacgauacauagacaguaagguaguaaagacgcgagccgagggagagugguuaucguucgacgucacggacgcgguccacgagugguuacaccacaaggaccgcaaccuuggcuucaagaucagucuccacugcccgugcugcacauucgucccuucgaacaacuauauaauaccgaacaagucggaggaguuagaggcucguuucgcgggaaucgacgggacgucgacguacacgucgggagaccagaagacgaucaagucgacgcgaaagaagaacucgggaaagacaccgcacuuguuauuaauguuguuaccgucguacagguuagagucgcagcagacgaaccgccgaaagaagcgagcgcuagacgcagcguacuguuuccgaaacguacaagacaacugcuguuuaaggcccuuauacaucgacuucaagcgcgacuuggguuggaaguggauccacgagccuaaggguuauaacgcaaacuucugcgcaggcgcgugccccuaccucuggucgucggacacccaacacagucgaguguuaucucuuuacaacacgaucaaccccgaggcgagugccucgccgugcugcgucucgcaggacuuggagccauuaacgaucuuguacuacaucgguaagacgccuaagaucgagcaguuaucgaacaugauagucaaaaguugcaagugcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5806 - RNA, 1586 nt, Artificial Sequence
  mRNA product Design3 comprising derived and/or modified sequence from Homo sapiens__NP_003230.1__HsTGFB3 (opt10)
gggagagucccgcagucggcguccagcggcucugcuuguucgugugugugucguugcaggccuuauucaagcuuaccaugaagaugcacuugcagagggcguugguaguauuagcguuauugaacuucgcgacgguaucguuaaguuuaucgacaugcacgacguuggacuucggccacaucaagaagaagcgcguagaggcgauacggggucagauauuaaguaaguuacgcuugacgucgccgccggagccgacgguaaugacacacguaccguaccagguauuagcguuauacaacaguacgagggaguuguuagaggagaugcacggugagcgcgaggaggguugcacgcaggagaacacggagucggaguacuacgcgaaggagauacacaaguucgacaugauacaggguuuagcggagcacaacgaguuggcgguaugccccaaggggauaacgaguaaggucuucagguucaacguaucgaguguagagaagaaccgcacgaacuuauucagggcggaguuccgaguauuaagggucccgaacccgucgaguaagcgaaacgagcagaggauagaguuauuccagauauuacgccccgacgagcacauagcgaagcagcgguacauaggggguaagaacuuacccacgcgcgguacggcugagugguugucguucgacguaacagacacgguaagggagugguuauuacgcagggagaguaacuugggcuuagagauaucgauacacugcccuugccacacguuccagccgaacggggacauauuagagaacauacacgagguaauggagauaaaguucaaggguguagacaacgaggacgaccacgggcgaggggacuuggggagguuaaagaagcagaaggaccaccacaacccccacuuaauauugaugaugauaccgccgcaccgauuagacaaccccggucagggggggcagcgaaagaagagggcguuagacacgaacuacugcuuccgaaacuuggaggagaacugcugcguaaggccguuauacauagacuuccgccaggacuuaggguggaaguggguacacgagccgaaggguuacuacgcuaacuucugcagugguccgugccccuacuugaggucggcagacacaacgcacaguacgguauuagguuuauacaacacguugaacccggaggcgucggcuaguccgugcugcguaccgcaggacuuagagcccuuaacaauauuguacuacguagggagaacgccgaagguagagcaguuaucgaacaugguaguaaagucgugcaagugcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5807 - RNA, 1733 nt, Artificial Sequence
  mRNA product Design3 comprising derived and/or modified sequence from Homo sapiens__NP_001057.1__HsTNFRSF1B (opt10)
gggagagucccgcagucggcguccagcggcucugcuuguucgugugugugucguugcaggccuuauucaagcuuaccauggccccgguggcggucugggcggcuuuagcgguagggcuugagcuuugggcggccgcgcacgcguuaccggcgcaggucgcguucacgcccuacgcucccgagccggguucaacgugcagguugcgcgaguacuacgaccaaacugcgcagaugugcugcucgaagugcuccccgggacagcacgcgaagguauucugcaccaaaacaucagacacggugugcgacucgugcgaggacucgacuuacacgcaauuauggaacugggugcccgagugccucucgugcggaucgcgaugcucgucagaccaaguagagacccaggccugcacgcgcgagcaaaaccggaucugcacgugccgcccgggcugguacugcgccuugucgaagcaggaggguugccgacucugcgcgccccuccgaaagugccggccggguuucgggguagcgcgaccugggacggagacgucggacguagucugcaagccgugcgcgcccggaacauucucuaacacgacaucgucuaccgacaucugccgcccgcaccagaucugcaacgucguugcaaucccggggaacgcgaguauggacgcgguaugcacaucgacgucgccgacgcgcucaauggcgccgggcgccgugcaccuuccgcagcccguaucgacgcggucgcagcacacccaaccgacgccggagccgucgaccgcgccgucgacuucguuccuuuuacccauggggcccucgccgcccgcggagggcucgaccggugacuucgcguugccgguaggguuaaucgugggcgucacggcguuaggguuguuaaucaucggcgucguaaacugcgugauaaugacgcagguaaagaagaagccgcugugcuugcagcgagaggcgaaggugccgcacuuaccggccgacaaggcccguggcacgcagggucccgagcagcagcacuuauuaauuaccgcgccgucgucgaguucgaguucguuggagucgagcgcaucggcccuagacaggcgagcccccacgcgaaaccagccgcaggcgccggguguggaggcgucuggggccggcgaggcccgugccucgaccggaucgucggacucgucgccgggcggacacgguacacagguaaacguaacuugcaucguuaacguaugcucgucgucggaccacucgagucagugcucgagucaggcgucgucgacgaugggggacacugacucgucgcccucagagaguccuaaggacgagcaggucccguucucgaaggaggagugcgccuuccguagucaacucgagacaccggagacgcuccucggaucaacggaggagaagccguuacccuuaggcguuccggacgcggggaugaagccgucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5808 - RNA, 860 nt, Artificial Sequence
  mRNA product Design3 comprising derived and/or modified sequence from Homo sapiens__NP_002623.2__HsPGF (opt10)
gggagagucccgcagucggcguccagcggcucugcuuguucgugugugugucguugcaggccuuauucaagcuuaccaugcccguaaugcgcuuauuuccauguuucuugcaguuauuagcgggcuuggccuuacccgcaguaccaccgcaacaaugggcucucucggcagggaacgguaguucggaaguugaggucgucccguuccaggaggucuggggucgaaguuacugcagggcccuugagcgccucguggacguaguaagugaguauccgagugagguagagcauauguucucgccuaguugcguuucuuuauugagguguacagguugcugcggugacgagaacuuacacugcguacccguagagaccgccaacguaacuaugcaauuauugaagauucgaucgggagaccguccaucguacguagaguuaaccuuuagucagcauguccguugcgagugccguccgcuucgcgagaaaaugaagcccgagcgucgaaggccuaaagggcgcgggaagcggcgcagggagaaacagcgaccuacggacugucacuugugcggggacgcggucccgcgacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5809 - RNA, 1586 nt, Artificial Sequence
  mRNA product Design3 comprising derived and/or modified sequence from Homo sapiens__NP_001020537.2__HsVEGFA (opt10)
gggagagucccgcagucggcguccagcggcucugcuuguucgugugugugucguugcaggccuuauucaagcuuaccaugaccgaccgccagaccgacacggcccccucgccguccuaccaccucuuacccggccggcgccggaccguggacgccgcggccucgcgcgggcagggccccgagcccgcccccgggggcggggucgagggcgugggcgcccgcgggguggccuuaaaguuauucguccagcucuuaggcugcucccgguucgggggcgcgguggugcgggccggggaggccgagcccucgggcgccgcgcgcuccgccucguccggccgggaggagccccagcccgaggagggggaggaggaggaggagaaggaggaggagcgcggcccgcaguggcgguuaggggcccgcaagcccggcucguggaccggcgaggccgccgucugcgcggacuccgcccccgccgcccgggccccgcaggcgcucgcccgcgccucggggcggggcgggcgcguggcccggcgcggcgccgaggaguccgggccgccccacucgcccucccggcgcggcucggcgucccgggccggccccgggcgcgccucggagaccaugaacuucuuauuauccugggugcacuggucgcucgccuuauuacucuacuuacaccacgccaaguggucccaggcggccccgauggccgagggcgggggccagaaccaccacgaggucgugaaguucauggacguguaccagcgcucguacugccaccccaucgagacguuagucgacaucuuccaggaguaccccgacgagaucgaguacaucuucaagcccucgugcgugccgcucaugcggugcgggggcugcugcaacgacgagggcuuagagugcgugcccaccgaggaguccaacaucaccaugcagaucaugcgcaucaagccccaccaggggcagcacaucggcgagaugucguucuuacagcacaacaagugcgagugccggcccaagaaggaccgcgcccggcaggagaagaaguccguccgcgggaagggcaaggggcagaagcggaagcgcaagaagucccgguacaagucguggucgguguacgugggcgcgcgcugcugccucaugccgugguccuuacccggcccccaccccugcgggccgugcucggagcggcgcaagcacuuauucguccaggacccgcagacgugcaagugcucgugcaagaacacggacucgcggugcaaggcgcgccagcucgaguuaaacgagcggacgugccgcugcgacaagccgcggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5810 - RNA, 1046 nt, Artificial Sequence
  mRNA product Design3 comprising derived and/or modified sequence from Homo sapiens__NP_001165094.1__HsVEGFA (opt10)
gggagagucccgcagucggcguccagcggcucugcuuguucgugugugugucguugcaggccuuauucaagcuuaccaugaacuucuuauugucguggguccacuggaguuuagcguuauuguuauacuuacaccacgcgaaguggucgcaagcagcgccgauggcggagggggguggucaaaaccaccacgagguaguaaaguucauggacguguaccagaggucguacugccacccgauagagacguugguagacauauuccaagaguacccggacgagaucgaguacaucuucaagccgucgugcguaccguuaaugcgcugcggugguugcugcaacgacgaggguuuagagugcgucccuacggaggagaguaacaucacuaugcagauaaugaggauuaagccgcaucaagggcagcacauaggggagaugucguucuugcagcauaacaagugcgagugccgaccgaagaaggaccgagcgcgacaggagaagaagaguguaagggguaaagggaagggucaaaagcgcaagaggaaaaagagucgauacaagucguggucgguauacgucggggccaggugcugcuuaaugccguggucguuaccagggccgcacccgugcgggccgugcucggagcgcaggaagcacuuauucguacaggacccacagacgugcaagugcaguugcaagaacacggacucgcguugcaaggcacgacaguuagaguuaaacgagcgaacgugccggugcgacaagccucgaaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5811 - RNA, 971 nt, Artificial Sequence
  mRNA product Design3 comprising derived and/or modified sequence from Homo sapiens__NP_003368.1__HsVEGFB (opt10)
gggagagucccgcagucggcguccagcggcucugcuuguucgugugugugucguugcaggccuuauucaagcuuaccaugucgccguuauugaggagguuauuauuggcggccuuguuacaauuagcgccggcgcaagcgccggugagucaaccggacgcgccggggcaucaacgcaaggucgucagcuggaucgacgucuacaccagggccacgugucaaccgagagaagucgucgucccgcucaccgucgaauugauggggacggucgcgaagcaauuagucccgucgugugucaccguccaaaggugcgggggguguuguccggaugacggguuagaaugcgucccgaccggccaacaucaggugagaaugcaaauauugaugauaagauaucccucgucgcaauuaggcgaaaugaguuuagaggagcauucgcaaugcgagugucgcccgaagaagaaagauucggccgucaaaccggaucgcgccgcgaccccgcaucauaggccgcaaccgaggagcguccccgggugggauagcgcgccgggggccccgaguccggccgauauaacgcacccgaccccggcgccggggccgagcgcgcaugccgccccgucgacgacgucggcguuaacgccggggccggcggccgcggccgcggaugcggccgccaguagugucgcgaaagggggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5812 - RNA, 1607 nt, Artificial Sequence
  mRNA product Design3 comprising derived and/or modified sequence from Homo sapiens__NP_005420.1__HsVEGFC (opt10)
gggagagucccgcagucggcguccagcggcucugcuuguucgugugugugucguugcaggccuuauucaagcuuaccaugcaccucuuaggguucuucagcgucgccugcuccuuacuggcggcggcccuccugcccgggccgcgcgaggccccggcggcggcggcggcguucgagagcggccuggaccucuccgacgccgagccggacgcgggggaggcgaccgccuacgccucgaaggacuuagaggagcagcugcgguccgucagcuccguggacgagcucaugaccgugcuguaccccgaguacuggaagauguacaagugccaguugcgcaagggcggguggcagcacaaccgggagcaggcgaaccucaacagccgcacggaggagaccaucaaguucgcggccgcccacuacaacaccgagauccucaaguccaucgacaacgaguggcggaagacccagugcaugccgcgcgaagucugcaucgacgucggcaaagaguucggcguggccacgaauacguuuuucaagccgcccugcgucaguguguaucggugcgggggcuguuguaacuccgaaggguuacaauguaugaauacgucgaccucguauuuaucgaaaacgcuguucgagaucaccguccccuugucccaggggccgaagcccgucaccauaucguucgcgaaccauaccucgugucgcuguaugagcaaguuagacguguaucgccaggugcacucgaucauccggcggaguuuacccgcgacguugccccaaugccaagccgccaauaaaacguguccgacgaacuauauguggaacaaccauauaugucgcuguuuagcccaagaggacuucauguucaguuccgacgccggggacgauagcaccgacggcuuucacgauauaugcggccccaauaaagaauuagacgaggaaacgugccaaugcgucugucgggcgggguugcgccccgcgucgugcggcccgcauaaggagcucgaucggaauagcugucaaugcgugugcaagaauaaguuguuuccgucgcagugcggggcgaaucgcgaguucgacgagaauacgugucaaugcgugugcaagcggacguguccgcgcaaccagccguugaaccccggcaagugcgcgugcgagugcaccgagucgccgcaaaagugucuccugaagggcaagaaauuucaucaucagaccuguucgugcuaucggcgccccugcaccaaucggcaaaaagccugcgaacccggguucagcuacuccgaggaggucugccgcugcgugcccagcuacuggaagcgcccgcagaugucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5813 - RNA, 1412 nt, Artificial Sequence
  mRNA product Design3 comprising derived and/or modified sequence from Homo sapiens__NP_004460.1__HsVEGFD (opt10)
gggagagucccgcagucggcguccagcggcucugcuuguucgugugugugucguugcaggccuuauucaagcuuaccauguacagggaaugggucguagucaacgucuucaugauguuauacguacaauuaguacaagguucgucgaacgagcacgguccggucaagcguucgucgcaaucgacguuagagcguucggagcagcagauacgagcggcgucgucguuagaggaguugcuacggauaacgcacucggaggacuggaaguuauggcgaugucgauuacgcuuaaagucguucacaucgauggacucgaggucggcuucgcaccgcucgacgcgguucgccgcgacauucuacgacauagagacguuaaaggucaucgacgaggaguggcagcgcacgcagugcucgccgagggagacuugcgucgaggucgcgucagaauuggguaagucgacuaacacguuuuucaagccuccgugcguuaacgucuuccguugcggggguugcugcaacgaggagucguuaaucugcaugaacacaaguacgucauacaucucgaagcaauuauucgagaucucggucccauuaaccucggucccggaguuggugccgguaaagguagcgaaccacacggggugcaagugcuuaccgacggcuccgcgacacccguacaguauaauacgacggucgauacagauucccgaggaggaccgaugcagucacucgaagaagcuaugcccaaucgacaugcucugggacaguaacaagugcaagugcguauuacaggaggagaaccccuuggcggggacggaggaccacucgcacuugcaggagccggcguugugcggaccgcacaugauguucgacgaggaccggugcgagugcguaugcaagacuccgugcccgaaggacuugauucagcacccuaagaacugcucgugcuucgaaugcaaggagucguuagagacgugcugccagaagcacaaguuguuccacccggauacaugcaguugcgaggaccgaugcccguuccacacacgacccugcgcgucggguaagacggcuugcgcgaagcacugccgauucccuaaggagaagcgagcggcacaggguccgcacucucguaagaacccgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5814 - RNA, 995 nt, Artificial Sequence
  mRNA product Design3 comprising derived and/or modified sequence from Homo sapiens__NP_002119.1__HsHMGB1 (opt10)
gggagagucccgcagucggcguccagcggcucugcuuguucgugugugugucguugcaggccuuauucaagcuuaccauggguaaaggugacccgaaaaagccacgcgguaagaugaguucguaugcguucuucguccaaacgugccgagaggaacacaagaaaaagcacccggacgcgucgguaaacuucucggaguucucaaaaaagugcuccgaacgcuggaagacgaugucggcgaaagagaaagguaaauuugaagauauggcgaaagcggacaaggcgcgcuacgagagggagaugaagacauauauaccgccgaagggugagaccaagaaaaaguucaaggacccgaacgcgccgaagcggccgccgucugcguuuuuccuuuucuguucggaguaccgcccgaagauaaagggagagcacccgggccuuucgauaggcgacguagcgaaaaaguugggugaaauguggaauaacacggcggcggacgauaaacagccauaugaaaagaaagcagcgaagcucaaggaaaaguacgagaaagauaucgcggcauaucgagcaaaagguaaaccggacgcggcgaagaaagguguaguaaaagcagaaaagucgaagaaaaagaaagaggaagaggaagaugaagaggacgaggaagaugaagaggaagaggaagaugaagaggacgaggacgaggaagaggacgaugacgaugaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5815 - RNA, 906 nt, Artificial Sequence
  mRNA product Design5 comprising derived and/or modified sequence from Homo sapiens__NP_061986.1__HsFGF21 (opt10)
gggagagucccgcagucggcguccagcggcucugcuuguucgugugugugucguugcaggccuuauucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5816 - RNA, 1686 nt, Artificial Sequence
  mRNA product Design5 comprising derived and/or modified sequence from Homo sapiens__NP_002412.1__HsMMP1 (opt10)
gggagagucccgcagucggcguccagcggcucugcuuguucgugugugugucguugcaggccuuauucaagcuuaccaugcauucguucccgccguuauuauuauuauuauuuuggggggucgucagccauucguuuccggccaccuuggagacccaggaacaggacgucgaucucgugcaaaaguauuuagagaaguauuauaauuuaaaaaacgacggccgccaggucgagaaaagacgcaacucggggccggucgucgagaagcucaaacagaugcaagaguuuuucggcuuaaaggucaccggcaagccggacgccgagacguuaaaagucaugaaacaaccgcgcugcggggucccggacgucgcccaauucguguugaccgaaggcaauccgaggugggaacagacccacuuaacguaucgcaucgagaacuauaccccggaccucccgcgcgccgacgucgaucacgcgaucgaaaaggcguuucaguuguggucgaacgugaccccguuaaccuuuacgaaagugagcgaagggcaggccgauauaaugaucagcuucgugcgcggggaccacagagauaauagcccguucgacgggccgggggggaacuuggcccacgccuuccagccggggccggggaucgggggcgacgcccacuucgacgaggacgagcgcuggacgaauaacuuucgcgaauauaaucuccacagggucgccgcccacgaguuggggcacagcuugggguugagucacagcaccgacauaggcgcccucauguauccgucguauacguuuucgggggacguccaauuggcccaagacgauaucgacgggauacaggcgaucuacgggaggagucagaacccggugcaaccgauagggccgcagacgccgaaggccugcgauucgaaauugacguucgacgccaucaccaccaucagaggggaggucauguuuuucaaggaucgcuuuuauaugaggaccaacccguuuuaucccgaggucgaauugaacuuuaucagcgucuuuuggccgcaguuaccgaacggcuuggaggccgccuaugaguucgcggaucgcgacgaggugagauucuuuaagggcaacaaauauugggccguccaagggcaaaacgucuugcauggguauccgaaagauauauauucgaguuucggguuuccgcgcaccgucaaacacauagacgccgccuugagcgaagagaauaccgggaagacguauuuuuucgucgccaauaaguauuggcgcuacgacgaguacaagaggagcauggacccgggguacccgaagaugaucgcccacgauuucccggggaucgggcauaaggucgacgccgucuuuaugaaggacggguucuuuuacuuuuuccacgggacccgccaguauaaguucgacccgaagaccaaacgcauccucaccuugcaaaaggccaacucgugguuuaauugucgcaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5817 - RNA, 3342 nt, Artificial Sequence
  mRNA product Design5 comprising derived and/or modified sequence from Clostridium histolyticum__BAA34542.1__ColH (opt10)
gggagagucccgcagucggcguccagcggcucugcuuguucgugugugugucguugcaggccuuauucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugccggaccucuuccaguacagcuccgacgcgaaggaguucuacggcaacaagacccggaugagcuucaucauggacgagaucgggcgccgggcgccccaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgccaccggccuccuggccggcaacgagaccgccccgcccgagguggucaacaacuucacgcccauccugcaggacugcaucaagaacaucgaccgguacgcccucgacgaccucaagagcaaggcccuguucaacgugcucgcggccccgaccuacgacaucaccgaguaccugcgcgccaccaaggagaagcccgagaacacgcccugguacgggaagaucgacggcuucaucaacgagcugaagaagcucgcccuguacgggaagaucaacgacaacaacuccuggaucaucgacaacggcaucuaccacaucgcgccccuggggaagcuccacagcaacaacaagaucggcaucgagacccugaccgaggugaugaaggucuacccguaccuguccaugcagcaccuccagagcgccgaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggggccgagcuguucgccgggagcacccgcaccuccggcauccugccgcgcaagagcaucgucuccaacauccacaacacgacccggaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccucuccagcaacuacgcccugaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagucccaguacuucagcacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugcccaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5818 - RNA, 2463 nt, Artificial Sequence
  mRNA product Design5 comprising derived and/or modified sequence from Homo sapiens__NP_000592.3__HsHGF (opt10)
gggagagucccgcagucggcguccagcggcucugcuuguucgugugugugucguugcaggccuuauucaagcuuaccaugugggucacgaaguuguuaccggcguuauuauuacaacacguguuguuacacuuguuguuauugccgauagcgauaccguaugccgaagggcagcgcaagcgccgcaauaccauccacgaguuuaagaagagugccaaaaccacguugauaaagaucgacccggccuuaaaaaucaagacgaaaaaggucaacaccgccgaucagugcgccaaccgcugcacccgcaacaagggguugccguuuaccuguaaagccuucgucuucgacaaggcccgcaagcaauguuugugguuuccguuuaacucgaugagcucgggggucaagaaggaguucgggcacgaguucgauuuguaugagaauaaggauuauauccgcaauuguauaaucgggaaagggaggucguauaaagggaccgucagcauaaccaaaucggggauaaaaugccaaccguggucgaguaugaucccgcaugagcauucguuccucccgagcucguacagagggaaggauuugcaagagaauuauugcaggaacccgaggggcgaggagggcgggccguggugcuuuaccucgaacccggaagucagguaugaggugugcgauaucccgcaaugcagcgaggucgaguguaugacguguaacggcgaaucguacaggggguugauggaccacaccgagagcgggaaaaucugccaaaggugggaccaccaaaccccgcauagacauaaauuucucccggagcgcuauccggauaaaggguucgacgacaacuacuguaggaacccggacgggcaaccccgcccgugguguuauaccuuggauccgcauacgaggugggaauauugcgccaucaaaaccugugccgauaacaccaugaacgauaccgacgucccgcucgagaccaccgaguguauacaggggcagggggagggguaucgcgggaccgugaacacgaucuggaacgggaucccgugccaaaggugggacagccaauauccgcaugaacacgauaugaccccggagaacuuuaaauguaaagauuugagggagaacuauuguaggaacccggacggcagcgagagcccguggugcuucacgaccgacccgaauauaagggucggguauuguagucagaucccgaauugcgacaugagccacgggcaagacugcuauaggggcaacgggaaaaacuacauggggaaucucagucagacccgcagcggguugaccugcagcaugugggauaaaaauauggaggaucuccacaggcacauauuuugggagccggacgccucgaaauuaaacgaaaacuauuguaggaacccggacgacgacgcccacgggccgugguguuauaccgggaacccguugaucccgugggacuauuguccgaucaguaggugcgagggggacacgaccccgaccaucgugaaccucgaucacccggucaucagcugcgcgaagaccaagcagcucagggucgucaacggcaucccgaccaggaccaauaucggguggauggucucgcuccgcuaucgcaacaagcacauauguggggggagccucaucaaagaaucgugggucuugaccgccaggcaaugcuuuccgagcagggaucucaaggacuacgaggccugguuggggauccacgacgugcaugggcgcggggacgaaaaguguaagcaagucuugaacgucagucaauuagucuacgggccggaggggagcgacuuaguccucaugaaauuggcgcgcccggccguguuagacgacuucgucucgaccaucgaccucccgaauuacggguguaccaucccggagaaaacgucguguucggucuauggguggggguauaccgggcucauaaauuacgacggguugcucagggucgcccacuuguauaucauggggaacgaaaaguguucgcaacaccacaggggcaaagucaccuuaaacgaaagcgagaucugcgccggcgccgagaaaaucgggagcgggccgugcgaaggcgacuauggggggccguuggucugcgaacagcacaaaaugcgcauggucuugggggugaucgucccggggagggggugcgcgaucccgaacaggccggggaucuucgugagggucgccuacuacgccaaguggauccauaagaucauccucaccuauaaagucccgcaaagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5819 - RNA, 852 nt, Artificial Sequence
  mRNA product Design5 comprising derived and/or modified sequence from Homo sapiens__NP_001133.1__HsAMELX (opt10)
gggagagucccgcagucggcguccagcggcucugcuuguucgugugugugucguugcaggccuuauucaagcuuaccauggguacguggauacucuucgcgugcuuguuaggugcggcguucgcgaugccguuaccgccgcacccaggccacccgggauacaucaacuucucguacgaggucuuaacgccgcucaagugguaccagaguauccgaccuccuuaccccucguacggauacgagccgaugggggguugguuacaccaccagauaauaccaguauugagucagcaacacccgccaacgcacacuuuacagccgcaccaccacauccccguaguccccgcgcagcaaccggucaucccgcaacagccgaugaugccgguacccgggcagcacucgaugacaccuauccagcaccaccaaccgaacuugccgccgccggcgcagcaacccuaccagccacagccgguccagccucaaccccaccagccuaugcagccucagccgccgguacacccgaugcagccguuaccaccgcagcccccguuaccgcccauguucccgaugcaaccccucccgccgauguuaccggacuuaacguuagaggcguggccuucgacggacaagacgaagcgcgaggagguugacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5820 - RNA, 411 nt, Artificial Sequence
  mRNA product Design5 comprising derived and/or modified sequence from Homo sapiens__NP_001133.1__HsAMELX-TRAP (opt10)
gggagagucccgcagucggcguccagcggcucugcuuguucgugugugugucguugcaggccuuauucaagcuuaccaugccguugccgccgcauccgggucacccgggguauauaaacuucucguaugaggucuugacgccgcucaagugguaccaaucgauucgcccgccuuacccgaguuauggguacgagccgauggggggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5821 - RNA, 855 nt, Artificial Sequence
  mRNA product Design5 comprising derived and/or modified sequence from Homo sapiens__NP_001134.1__HsAMELY (opt10)
gggagagucccgcagucggcguccagcggcucugcuuguucgugugugugucguugcaggccuuauucaagcuuaccauggguacauggauauuauucgcgugcuuggucggugcugcauucgcaaugccauuaccuccccacccaggccacccgggguacauuaauuucucguacgagguauuaacgccgcuuaaaugguaccagaguaugaucaggccgccguacucgucguacggauacgaacccaugggggguugguuacaucaccagauaauaccgguagucucgcagcagcacccguuaacgcacacguugcaaucgcaccaccacauaccgguaguaccggcgcagcaaccucgcguuaggcagcaggcguuaaugccgguaccggggcagcagucgaugacaccgacccagcaccaccagccgaacuuaccauuacccgcucaacagccauuccagccgcaacccguccagccgcaaccccaucagccgaugcaaccgcaaccgccgguacagccgaugcagccguuguuaccgcagccgccguugccacccauguucccguuacgcccuuuaccuccgaucuuaccggacuuacacuuagaggcauggccggcgacggacaagacgaagcaggaggagguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5822 - RNA, 414 nt, Artificial Sequence
  mRNA product Design5 comprising derived and/or modified sequence from Homo sapiens__NP_001134.1__HsAMELY-TRAP (opt10)
gggagagucccgcagucggcguccagcggcucugcuuguucgugugugugucguugcaggccuuauucaagcuuaccaugccguugccgccgcacccgggccauccgggguacauaaauuuuucguacgaagucuugacgccgcucaaaugguaucaaucgaugauccgcccgccguauagcaguuacggguaugaaccgauggggggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5823 - RNA, 3237 nt, Artificial Sequence
  mRNA product Design5 comprising derived and/or modified sequence from Homo sapiens__NP_006120.1__HsBMP1 (opt10)
gggagagucccgcagucggcguccagcggcucugcuuguucgugugugugucguugcaggccuuauucaagcuuaccaugcccggagucgcgcgauugccauugcucuuagguuuguuauuauuaccacgcccggggaggccccucgacuuagcggacuacacguacgacuuggcagaggaggacgacucugaaccuuuaaacuacaaggacccgugcaaggcugccgcguucuuaggggacauagcguuggacgaggaggacuuacgcgcuuuccaaguccagcaggcgguugacuuaaggcgccacacggcgcggaaaaguucgaucaaggcggcgguacccgggaacacaaguacgccgucgugccaaaguacaaacggacaaccacagcgcggggcgugcggacgguggcgagggaggucgaggaguaggcgagcagccaccucgcgucccgagcggguauggccggacgguguaauuccauucguaauagguggcaacuucacgggaagucagcgggcgguauuccgccaggcgaugcgacacugggagaaacacacaugcguuacguucuuggagcgaaccgacgaggacucguacauaguauuuacguaccguccaugcggcugcugcaguuacguagggcgaagggguggcgguccgcaagcgaucucgauagguaagaacugcgacaaguucgguaucguaguucacgaguuaggucacguuguagguuucuggcacgagcacacgcgaccugaccgcgacaggcacgucaguauaguccgcgagaacauacagccgggacaggaguacaacuucuuaaaaauggagccgcaagagguugagucguugggugagacguacgacuucgacucgauaaugcacuacgcgcgaaacacguucucgcgcgggauuuucuuagacacaauaguuccgaaauacgagguaaacggcgucaagccgccgauaggccagcggacucgcuugucgaagggugacauagcgcaggcgcggaaguuguauaagugcccggcgugcggugagacauuacaggacucgacgggaaacuuuaguucgcccgaguacccuaacggcuacucggcgcacaugcacugcgucuggcgaauaucgguaacuccgggggagaagauuauuuuaaauuucacuucauuggauuuauauaggucgcgauuauguugguacgacuacguagaaguaagggacggguuuuggcguaaggccccuuugcgugggcgauucugcggaucgaaguuaccggagccgauaguaaguacggacucgcguuuauggguagaguuccgaaguucgaguaacuggguagguaaggguuucuucgccguuuacgaggcaauaugcgguggggacguaaagaaggacuacggucauauacagucuccgaauuacccggacgacuacaggccuaguaagguauguauauggcgcauccaagucucggagggauuccauguuggguugacguuucagaguuucgagauagagaggcacgacucgugcgcguacgauuacuuagagguaagggacggacauucggagucgaguacuuuaauaggacgauacugcgguuacgagaagccggacgacauaaagucgacuucgucgcgauugugguuaaaguucguuucggacggaaguauaaacaaggcagguuucgcgguuaacuucuuuaaggagguagacgagugcucgcgaccgaaccgaggcgguugcgagcaacgaugcuuaaacacguugggaucuuacaaaugcucuugcgacccggguuacgaguuggcgccggauaagaggcgaugcgaggcggcaugcggggguuucuuaacaaaguugaacgguucgauaacaucgcccggguggccgaaggaguacccgccgaacaagaacugcauauggcaauuagucgcgccgacacaauaccggauuucguuacaguucgacuucuucgagacggaggguaacgacgucuguaaguacgacuucgucgagguccgaucggguuugacugcggacucaaaguuacacgguaaguucugcggcucggagaagccggagguaauuacaucgcaguacaacaacaugcgagucgaguucaagucggacaacacgguaaguaagaagggguucaaggcacacuucuucucggauaaggacgaguguucgaaagacaacggggguugccaacaggacugcguaaacaccuucgguucguacgagugucagugccgaucggguuucguauuacacgacaacaagcacgacugcaaggaggcaggaugcgaccauaaggucacgucgacuucggggacgauaacgucgccgaacuggccggacaaguacccgucgaagaaggagugcaccugggcgaucucgucaacuccgggucaucgaguuaaguugacguucauggagauggauauugagucgcagcccgagugcgcguacgaccacuuagagguauucgacgggcgugacgcgaaagcaccgguauuaggaagguucugcgguucgaagaaacccgaaccgguuuuggcgacgggaagucguauguucuuacgguucuacucggacaauaguguacaacguaagggguuccaagcaucgcaugcgacggagugcgguggucagguccgagcggacguuaaaacgaaagacuuauacucgcacgcgcaguucggggacaauaacuacccgggcgggguugacugcgaguggguuauagucgcagaggagggguacgguguagaguuaguauuccagacuuucgaggucgaggaggagacggacugcgguuacgacuacauggaguuauucgacgguuacgacucgacggcgccacgauuagguagguacugcgggucgggaccgccggaggagguauacucagccggugacaguguauuagucaaguuucacucugacgacacgauaacgaagaagggcuuccacuuacguuacacgaguacgaaguuccaggacacguuacacucucgaaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5824 - RNA, 1467 nt, Artificial Sequence
  mRNA product Design5 comprising derived and/or modified sequence from Homo sapiens__NP_001191.1__HsBMP2 (opt10)
gggagagucccgcagucggcguccagcggcucugcuuguucgugugugugucguugcaggccuuauucaagcuuaccauggucgcgggcacgagguguuuguuggcacucuuauugccgcaaguauuguuagggggggccgcgggguugguccccgaguuagggaggcgcaaguucgccgccgcaagcagcgggaggccgagcagucagccgagcgacgagguauuaucggaguucgagcucagauuauugucgauguucggguuaaaacaacgcccgacgccgucgcgcgacgcggucgucccgccguauauguuggacuuauauaggcgccacagcgggcagcccgggagcccggcgccggaccacagacucgagcgcgcggcgucgagggcgaacacggucaggucguuccaccaugaagaaagccucgaagaauugccggaaacaucgggcaaaacgacgagacgcuucuucuuuaaucucucgagcauaccgaccgaggaguuuauaacgagcgccgaguugcaagucuucagggaacagaugcaagaugcgcucgggaacaauucgucguuccaucacaggauaaauauauaugaaauaauuaaaccggccacggcgaacagcaaauucccggucacgcgcuugcucgacacgcgccucgucaaucagaaugcgucgcgcugggaaucguuugauguaacgccggcggucaugagauggaccgcccaggggcacgcgaaccauggguucgucgucgaagucgcgcaccucgaggagaaacaagggguaaguaagcgccauguccgcauuucgcgcagccuccaccaagaugaacacucguggagccagauucgcccgcucuuggucacguuugggcaugaugggaaaggccauccguugcacaaacgcgaaaaaaggcaagcgaaacacaaacaaagaaaaagguugaagaguucguguaagcgccacccgcucuacgucgacuucucggacgucgguuggaaugacuggauagucgccccgccuggcuaucacgcguuuuauugccacggggaaugcccguuuccguuagccgaucauuuaaacaguacgaaucaugcgauaguccagacacucguaaacagcgucaacagcaagauaccgaaagcgugcuguguacccacggaauugucggcgauaagcauguuauauuuggacgagaaugaaaaggucguccucaaaaauuaucaggacauggucgucgagggguguggcuguaggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5825 - RNA, 1503 nt, Artificial Sequence
  mRNA product Design5 comprising derived and/or modified sequence from Homo sapiens__NP_001193.2__HsBMP4 (opt10)
gggagagucccgcagucggcguccagcggcucugcuuguucgugugugugucguugcaggccuuauucaagcuuaccaugauaccgggaaacaggauguuaaugguaguauuguugugccagguauuauuggguggugccucgcacgcgaguuugaucccggagaccgguaagaagaagguagcggagauccagggccacgcggggggccgacguagcggucagucgcacgaguuauugcgagacuucgaggccacgcucuuacagauguucggucuucgccgaaggccgcagccgucuaagucggccgucauacccgacuacaugcgagacuuauaccgauuacagucgggcgaggaggaggaggagcagauccacaguacgggguuagaguacccggagcguccggccucgcgagcgaacacgguccgcucguuccaccacgaggagcacuuggagaacauaccgggcaccucggagaacagugcguucagauucuuauucaacuuaucgaguaucccagagaacgaggugauaucuagugcggaguugcgcuuauuccgugagcagguugaccaagggccggacugggagcgcggcuuccaccgaaucaacaucuacgaggugaugaagccgccggcggagguaguacccggucacuuaaucacucgucucuuagacacgcgauuaguacaccacaacguaacgaggugggagacguucgacgucaguccggcgguauugagguggacgcgcgagaagcagcccaacuacggauuagcgaucgaggucacgcaccuacaccagacccguacgcaccagggccagcacguccgaauaucgcgaucgcuaccgcagggaucggguaacugggcgcaauuaagaccguuguuaguaacguucggccacgacgggcgaggccacgcuuuaacgcgucgacgacgugcgaagcgcucgccgaagcaccacucgcagcgagcgcgaaagaagaacaagaacugccgacgucacagucuuuacguugacuucucggacgucggauggaacgacuggauaguugcgccgccgggcuaccaggcguucuacugccacggggacugcccguucccguuagccgaccacuuaaacaguaccaaccacgccaucguccagacgcuuguaaacucgguaaacaguucaauacccaaggcgugcugcguacccacggaguuaagugcgaucucgauguuauacuuggacgaguacgacaagguuguuuuaaagaacuaccaggagaugguuguggagggcugcggaugccguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5826 - RNA, 1818 nt, Artificial Sequence
  mRNA product Design5 comprising derived and/or modified sequence from Homo sapiens__NP_001709.1__HsBMP6 (opt10)
gggagagucccgcagucggcguccagcggcucugcuuguucgugugugugucguugcaggccuuauucaagcuuaccaugcccggcuuaggcagacgcgcccaaugguuauguuggugguggggcuuauuauguucguguuguggcccgccccccuuaagacccccgcucccggccgcggccgcggcggcggcgggcggccaauuauuaggcgaugggggcucgccggggaggaccgaacaacccccccccagcccccaaaguaguagcggguuuuuauauagaagauugaaaacccaagaaaaaagagaaaugcaaaaagaaauacucagcgucuuaggcuugccccauagaccgagaccguuacauggguugcagcaaccccaaccgcccgccuugagacaacaagaagaacaacaacaacaacaacaauuaccgaggggggaaccgccgccgggcagguuaaaaagugccccguuguuuauguuagacuuauauaaugcguuaagugcggauaaugaugaagauggcgccagcgaaggcgaacgccaacaaaguuggccgcaugaggccgcgucgagcagucaaaggagacaacccccgcccggggcggcccaucccuugaauaggaaaucguuguuagcgccggggagcgggucggggggggccaguccguuaacgucggcccaagauucggcguuuuugaaugaugccgauauggugaugucguucgucaauuuagucgaauaugauaaagaauuuaguccgaggcaaaggcaucauaaggaauuuaaauuuaaucucagucaaaucccggaaggggaagucgucaccgccgccgaguuuaggauauauaaagauugcgucaugggcucguucaagaaucagaccuucuugauaucgaucuaccaggugcuccaagaacaccaacaucgcgauagcgauuuauuccuccucgauacgagggucgucugggcgagcgaggaggggugguuagaguucgauauaaccgcgaccucgaacuuaugggucgucaccccgcaacacaauaugggcuugcaauuaucggucgucacccgcgacggggugcaugugcauccgagggcggccggguuagucgggcgcgaugggccguaugauaaacaaccguuuauggucgccuuuuuuaaggucucggaaguccaugucaggacgacgcgcagcgcgaguucgagaaggaggcagcaaucgaggaacaggagcacgcaaagucaagaugucgccagagugaguucggccagcgacuauaauucgucggagcucaagaccgcgugucgcaaacacgaauuauacgucucguuucaggauuuaggguggcaagauuggauaaucgccccgaaaggguacgccgcgaacuauugcgacggggaguguaguuuuccguugaaugcccauaugaacgccacgaaucaugccaucguccaaacgcucguccauuugaugaauccggaauacgugccgaagcccuguugcgccccgaccaaauugaacgcgauaagcgucuuguauuucgacgauaauaguaacgugaucuuaaagaaguaucgcaacauggucguccgcgccugcgggugucauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5827 - RNA, 1572 nt, Artificial Sequence
  mRNA product Design5 comprising derived and/or modified sequence from Homo sapiens__NP_001710.1__HsBMP7 (opt10)
gggagagucccgcagucggcguccagcggcucugcuuguucgugugugugucguugcaggccuuauucaagcuuaccaugcacguaagaucguuacgagcggcggcuccgcacaguuucguagcguugugggccccguuauucuuauugcgaucggcguuagcggacuucaguuuagacaacgagguacacucgaguuucauacaccgaagauugcgcucgcaggagaggcgcgagaugcagcgagagauauuaaguauauuaggguugccgcaccgacccaggccccacuugcaggggaagcacaacucggcuccaauguucauguuagacuuauacaacgcgauggcgguagaggagggggggggucccgggggucagggcuucaguuaccccuacaaggcgguauucucuacgcaggguccgccguuagcgaguuuacaggacucgcacuucuugacggacgcggacaugguaaugaguuucguaaacuuaguagagcacgacaaggaguucuuccacccgcgauaccaccacagggaguuccgauucgacuuaucgaagauacccgagggggaggcgguaacggcggcggaguucaggauauacaaggacuacauccgagagagauucgacaacgagacguuccgaauaaguguauaccagguauugcaggagcacuuagguagggagucggacuuauucuuguuagacagucgcacguuaugggcgucggaggaggguugguuggucuucgacauaacggcgacgaguaaccacugggucguaaaccccaggcacaacuuagguuuacaguugucgguagagacauuagacggucagucgauaaacccgaaguuagccggguugaucggucgacacggcccgcagaacaagcagccguucaugguagccuucuucaaggcgacggagguacacuucaggaguauaaggucgacggguaguaagcagcgaucgcagaacaggaguaagacaccaaagaaccaggaggcguuaagaauggcgaacguagcugagaacucgaguucggaccagaggcaggcgugcaagaagcacgaguuauacguaaguuuccgcgacuugggguggcaggacuggauaauagcgccggagggguacgcagcguacuacugcgagggugagugcgcguuccccuuaaacucguacaugaacgcgacgaaccacgcgauaguacagacguuaguacacuucaucaacccggagacaguaccgaagccgugcugcgcgccgacgcaguugaacgcgauaaguguauuauacuucgacgacucgaguaacguaaucuuaaagaaguacaggaacaugguaguacgagcgugcgguugccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5828 - RNA, 576 nt, Artificial Sequence
  mRNA product Design5 comprising derived and/or modified sequence from Homo sapiens__NP_006264.2__HsCCL7 (opt10)
gggagagucccgcagucggcguccagcggcucugcuuguucgugugugugucguugcaggccuuauucaagcuuaccaugaaggcgucggccgcguuacuaugcuuauuacuuaccgccgcggcguucucgccgcagggcuuagcgcaaccgguagguauaaacaccaguacgacaugcugcuacagguucauaaacaagaagaucccgaagcagcgauuagagaguuaccgucguacgacgagcucucacugcccgcgugaggcggucauauucaaaacgaaguuagacaaggagauaugcgcagaccccacccagaaguggguacaggacuucaugaagcacuuagacaagaagacgcagacgccuaaguugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5829 - RNA, 3900 nt, Artificial Sequence
  mRNA product Design5 comprising derived and/or modified sequence from Homo sapiens__NP_001954.2__HsEGF (opt10)
gggagagucccgcagucggcguccagcggcucugcuuguucgugugugugucguugcaggccuuauucaagcuuaccauguuauugaccuugauaaucuuacucccggucgucagcaaguucucguucgucucguugagcgccccccaacauuggucgugcccggaggggaccuuggccgggaacggcaacaguaccugcgucgggccggccccguuucucaucuuuagucacgggaacucgauauuccgcaucgauaccgaggggacgaacuacgaacagcucgucgucgacgccggggugagcgucauaauggacuuccacuacaacgaaaagcgcauauacugggucgaccucgagcgccaguugcuccagcgcgucuucuuaaacggcagccgccaggaacgcgucugcaacaucgaaaagaacgucagcgggauggccaucaacuggaucaacgaggaggucaucuggagcaaccagcaagaggggauaaucaccgucaccgacaugaaggggaacaacagucauaucuugcucucggcccucaaguacccggccaacgucgccgucgacccggucgagcgcuucaucuucuggagcagcgaagucgccgggucguuguaccgcgccgacuuggacggggucggggucaaagccuuacucgaaaccagcgaaaagaucaccgccgucagccucgacgucuuggacaaaagauuauucuggauccaauauaaucgcgaggggucgaacagcuugaucuguaguugcgacuacgacggggggagcgugcauaucucgaagcacccgacccaacacaaccucuucgccaugaguuuguucggggauaggauauuuuacagcaccuggaagaugaaaaccaucuggaucgcgaauaagcauaccgggaaagauaugguccgcaucaauuugcacagcagcuucgucccguugggggaguuaaaggucguccacccguuggcccagccgaaagccgaggacgauaccugggaaccggaacaaaaguuguguaagcuccgcaaggggaauuguucgucgaccgucugcggccaggauuugcaaagccaucucuguaugugcgccgaaggguaugcguugucgagggauagaaaauauugcgaggacgucaacgagugcgccuucuggaaccacgggugcaccuugggcugcaagaauacgccggggaguuacuauuguaccuguccggucggguucgucuuauugccggacggcaagaggugccaccaguuggucaguugcccgaggaacgucagcgaguguucgcacgauugcgucuuaaccagcgaggggccgcucugcuuuugcccggaggggagcgucuuggaacgcgacggcaagaccugcucggggugcaguagcccggacaacggggggugcucgcaauugugugucccguugucgccggucaguugggagugcgacuguuucccgggcuacgauuugcaguuagacgagaagucgugcgccgccagcgggccgcagccguuccucuuauucgcgaacagccaggacaucaggcauaugcacuucgacgggaccgauuacgggaccuuauugucgcaacaaauggggauggucuacgcguuggaccacgauccggucgagaacaaaaucuauuucgcgcacaccgcguuaaaauggaucgaacgcgccaacauggacgggagucaaagggagcgcuugaucgaagagggggucgacgucccggagggguuggccgucgauuggaucgggaggcgcuuuuacuggaccgaucgcggcaagagcuuaaucgggcgcucggaccucaacggcaagaggaguaagaucauaaccaaagaaaauauaagccagccgagggggaucgccguccacccgauggcgaaacgccucuuuuggaccgacaccggcaucaacccgaggaucgagucgagcaguuugcagggguuggggagguuagucaucgcgucgagcgacuugauauggccgucggggaucaccaucgauuuucucaccgauaaacucuauuggugugacgcgaaacaaagcgucaucgagauggcgaacuuagacgggagcaagaggaggcgcuugacgcaaaacgacgucgggcauccguucgccgucgccgucuucgaagacuacgucugguuuagcgacugggccaugccgagcgucaugcgcgucaauaaacgcaccgggaaggaccgcgucagguugcaggggucgauguuaaaaccgagcagcuuagucgucguccacccgcucgccaagccgggggccgacccgugucucuaccagaauggggggugcgagcacaucuguaagaaacgcuuggggaccgccuggugcagcugcagggagggguucaugaaggcgagcgacggcaagaccugcuuagccuuagacgggcaccaauuacucgccgggggggaggucgacuugaaaaaucaggucaccccgcucgauauacucaguaaaacccgcgucagcgaggacaauaucaccgagagccagcauauguuggucgccgagauaauggucagcgaccaggacgauugcgccccggucggguguucgauguacgccagaugcaucagcgaaggggaagacgcgaccugccaaugccucaagggguucgccggcgacgggaaguugugcagcgacaucgacgagugcgaaaugggggugccggucuguccgccggcgaguaguaaauguauaaauacggaggggggguacguguguagauguagcgagggguaucagggggacggcauccauugcuuggacaucgacgaaugucaguuaggcgaacauucgugcggggaaaacgcgucguguaccaacaccgaagggggguacacguguaugugcgccgggagguuaagcgagccgggguuaaucuguccggauagcaccccgccgccgcauuugcgcgaggacgaucaucauuacaguguccgcaacucggauagcgagugcccguuaagucaugacggcuauuguuugcacgacggggucuguauguacaucgaggcccucgauaaauacgccuguaauugcgucgucggguauauaggcgaaaggugccaauauagggauuuaaaauggugggaguuaaggcaugccgggcauggccaacaacaaaaagugauagucgucgccgugugugucgucgucuuggugauguuauuguuguuaucguuauggggcgcgcauuauuaucgcacccaaaaauuauugagcaagaauccgaaaaacccguacgaagaaagcucgcgcgacguccgcucgaggcgcccggccgauaccgaagacggcaugaguagcuguccgcagccgugguucgucgucaucaaggagcaucaggauuugaaaaacggcgggcagccggucgccggggaagacgggcaagccgccgacggcagcaugcagccgaccagcuggcgccaagaaccgcaacucugcgggauggggaccgaacagggguguuggaucccggucaguucggacaaagggaguugcccgcaagucauggaaaggucguuccacaugccgaguuacggcacccaaacguuggagggcgggguggaaaaaccgcacagcuuguugagcgccaauccgcucuggcagcagcgcgcguuagauccgccgcaucagauggaauuaacccaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5830 - RNA, 786 nt, Artificial Sequence
  mRNA product Design5 comprising derived and/or modified sequence from Homo sapiens__NP_001423.1__HsEREG (opt10)
gggagagucccgcagucggcguccagcggcucugcuuguucgugugugugucguugcaggccuuauucaagcuuaccaugacggccggccgccgcauggaaauguugugcgcggggcgcgugccggccuuauuauuguguuuaggguuucacuuguugcaagccguguugucgaccaccgucaucccgagcugcauaccgggggaaaguucggacaauuguaccgcccucguccaaaccgaggauaacccgagggucgcccaggucagcaucaccaaaugcucgagcgauaugaacggguacugccuccacgggcaauguauauacuuagucgauaugucgcagaauuauugucgcugcgaggucggguacaccggggugaggugcgagcauuuuuuccucacggugcaucagccgcucucgaaggaguacgucgcccucacggucaucuugaucauccucuucuugauaaccgugguggggaguaccuacuacuuuugucgcugguaucgcaacaggaagucgaaggagccgaaaaaagaguacgaacgcgucacgagcggcgacccggaacucccccaggugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5831 - RNA, 744 nt, Artificial Sequence
  mRNA product Design5 comprising derived and/or modified sequence from Homo sapiens__NP_000791.1__HsFGF1 (opt10)
gggagagucccgcagucggcguccagcggcucugcuuguucgugugugugucguugcaggccuuauucaagcuuaccauggcggagggugagauaacgacguucacugcguuaacggagaaguucaacuuaccgccggguaacuacaagaagcccaaguuguuauacugcucgaacggggggcacuucuuacgaauauuaccagacggcacgguagacgguacccgagaccggucggaccagcacauccaguuacaauuaucggcggagaguguuggcgagguauacaucaagucgacugagacagggcaguacuuggcgauggacacggacggguuauuguacgggagucaaacgccgaacgaggagugcuuauucuuagagcgcuuggaggagaaccacuacaacacguacaucucgaagaagcacgcggagaagaacugguucguaggguuaaagaagaacgguaguugcaagcgggggccacgcacgcacuacggucagaaggcgaucuuauucuugccguuaccaguaucgagugacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5832 - RNA, 1143 nt, Artificial Sequence
  mRNA product Design5 comprising derived and/or modified sequence from Homo sapiens__NP_001997.5__HsFGF2 (opt10)
gggagagucccgcagucggcguccagcggcucugcuuguucgugugugugucguugcaggccuuauucaagcuuaccauggugggcgucgggggcggggacguggaggacgugaccccgcgcccgggcgggugccagaucucgggccggggcgcccgcgggugcaacggcauccccggggccgcggccugggaggccgcccugccccggcgccggccccgccggcacccguccgucaacccccgcucgcgggccgcgggcucgccccgcacccgggggcgccggacggaggagcgccccuccggcucccggcucggcgaccgcgggcggggccgcgcccugcccgggggccggcugggcgggcgcggccgggggcgcgcccccgagcgcgugggcgggcggggccgcggccgggggaccgccgcgccccgcgccgcccccgccgcccggggcucgcgcccggggcccgcgggcaccauggccgccggguccaucaccacgcuccccgcccugcccgaggacggcggcucgggggccuucccgcccggccacuucaaggaccccaagcggcuguacugcaagaacgggggcuucuuccuccgcauccaccccgacgggcggguggacggcguccgcgagaaguccgacccgcacaucaagcugcagcugcaggcggaggagcggggcguggugucgaucaagggggucugcgccaaccgcuaccucgccaugaaggaggacggccggcugcuggccuccaagugcgugaccgacgagugcuucuucuucgagcgccucgagucgaacaacuacaacaccuaccggucccgcaaguacaccucgugguacguggccuuaaagcggacggggcaguacaaguuaggcuccaagaccggccccgggcagaaggcgauccucuucuuacccaugucggccaaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5833 - RNA, 861 nt, Artificial Sequence
  mRNA product Design5 comprising derived and/or modified sequence from Homo sapiens__NP_002000.1__HsFGF7 (opt10)
gggagagucccgcagucggcguccagcggcucugcuuguucgugugugugucguugcaggccuuauucaagcuuaccaugcacaaguggauauuaacguggauauugccgacguuauuauacaggucgugcuuccacauaauaugcuuggucgggacaauaaguuuagcgugcaacgacaugacgcccgagcaaauggcgacgaacguaaauugcucgaguccggagagacacacgaggucguaugacuauauggaggggggcgacauaagagucaggagauuauucugcaggacacaaugguauuugagaauagacaagaggggcaaagucaaggggacgcaagagaugaaaaacaacuauaacauaauggagauaagaacgguagccgucggcauagucgcgauaaaagggguagagagugaguucuauuuagcgaugaacaaggaggggaaguuauaugcgaagaaggagugcaacgaggacugcaauuucaaggaguugauauuagagaaccacuauaacacguacgcgucggccaaguggacacacaacggcggggagauguucgucgcguuaaaccaaaagggcauaccggucagggggaagaagacgaagaaagagcaaaagacggcgcacuucuugccgauggcgauaacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5834 - RNA, 903 nt, Artificial Sequence
  mRNA product Design5 comprising derived and/or modified sequence from Homo sapiens__NP_001936.1__HsHBEGF (opt10)
gggagagucccgcagucggcguccagcggcucugcuuguucgugugugugucguugcaggccuuauucaagcuuaccaugaaguuguuacccucaguuguacucaaauuauucuuagcggccguauuaagugcucuugugaccggcgagucguuggagcguuugcgccgcggucuugcagcgggcacgaguaacccggacccgccgacggucucgaccgaccaguuacucccucucgggggcgggcgcgaccguaagguucgggaccuccaggaggcggacuuagaccuccuacguguuacgcuuucgucgaagccccaggccuuggcgaccccuaacaaggaggagcacgguaagcguaagaagaaggggaaggggcuuggcaagaagcgugacccgugcuugcgaaaguacaaggacuucugcauacacggggagugcaaguacgucaaggaguuacgagcgccgaguugcaucugccacccgggcuaccacggggagcgaugccacggcuugucguuaccgguagagaaccguuuguacacuuacgaccacacuaccauacucgccguagucgcgguugucuuaucgucgguaugcuuauuaguaauaguaggcuuauuaauguuccgauaccaccgacgcgggggcuacgacguagagaacgaggagaaggugaagcuagggaugacgaacucgcacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5835 - RNA, 2463 nt, Artificial Sequence; identical to SEQ ID NO: 5818
  mRNA product Design5 comprising derived and/or modified sequence from Homo sapiens__NP_000592.3__HsHGF (opt10)

SEQ ID NO: 5836 - RNA, 2202 nt, Artificial Sequence
  mRNA product Design5 comprising derived and/or modified sequence from Homo sapiens__NP_005336.3 __HsHSPA1A (opt10)
gggagagucccgcagucggcguccagcggcucugcuuguucgugugugugucguugcaggccuuauucaagcuuaccauggcgaaggcggcggcaauagggauagacuuagguacgacguacucgugcguugguguauuccagcacgguaagguagagauaauagcgaacgaccaggguaaccggacgacgccgaguuacgucgcguucaccgacacggagcgcuugaucggggacgccgcgaagaaccagguagcuuuaaacccacaaaacacgguuuucgacgcaaagcgacucauagggcgaaaguucggggaccccgucguacaaucagacaugaagcacuggccguuccaggucauaaacgacggugacaagccgaagguccagguaaguuacaagggcgagacgaaggcguucuacccugaggagaucucaaguaugguauugacgaagaugaaggagauagcggaggcauacuuaggauaccccgugacgaacgccguaaucacgguccccgcguacuucaacgacucucagcggcaggcgacgaaggacgcaggcguaaucgcaggguuaaacguauugcgcaucauaaacgagccgaccgcggcggcgauagcauacggguuagaccggaccgggaagggugagcgaaacguauuaaucuucgacuuggguggggguacguucgacgucucgauauuaaccaucgacgacggcauauucgagguaaaggcgaccgccggggacacgcacuuaggcggggaggacuucgacaaccgauuggucaaccacuucguagaggaguucaagcgaaagcacaagaaggacauaucgcagaacaagcgugcgguaagaagguuacgaacggcgugcgagcgggcuaagcgcacguuaaguucgaguacgcaggcgucguuggagauagacaguuuauucgaggguauagacuucuacacuucgauaacgcgugcacgauucgaggaguuaugcucggacuuauucaggucgacguuagagccgguagagaaggcauuacgagacgcgaaguuggacaaggcacagauacacgacuuaguauuaguaggugguucgacgcggauaccgaagguacagaaguuguuacaggacuucuucaacggucgagacuuaaacaagucgaucaacccggacgaggcgguagcguacggggccgcgguacaggccgcgauauugaugggugacaagagugagaacguacaggacuuauuauuauuagacguagcacccuuaucuuuggguuuagagaccgcggguggggucaugacggcguuaauaaagcgaaacucgacgaucccgacgaagcagacccagaucuucacuacguacucggacaaccagccggguguauugauccagguauacgagggugagcgagcgaugaccaaggacaacaacuuauuaggacguuucgaguugucggguauaccgcccgcaccucgaggggucccgcagaucgaggucacguucgacaucgacgcgaacgguaucuuaaacguaacggcgaccgacaaaaguacggggaaggccaacaagaucacgauaacgaacgacaagggucgauuaucgaaggaggagauagagaggaugguccaggaggcagagaaguacaaggccgaggacgagguccagagagagcgaguaagugcgaagaacgcguuggagucguacgcguucaacaugaagagugcggucgaggacgaggguuuaaaggguaagaucucggaggccgacaagaagaaggucuuagacaagugccaggagguuauaucuugguuagacgcgaacacguuagcggagaaggacgaguucgagcacaagcgcaaggaguuagagcagguaugcaacccgauaauaucggguuuguaccagggggcgggcgggccggguccgggugguuucggcgcgcagggaccgaagggugguagugggucggguccgacgaucgaggagguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5837 - RNA, 2202 nt, Artificial Sequence; identical to SEQ ID NO: 5836
  mRNA product Design5 comprising derived and/or modified sequence from Homo sapiens__NP_005337.2 __HsHSPA1B (opt10)

SEQ ID NO: 5838 - RNA, 2202 nt, Artificial Sequence
  mRNA product Design5 comprising derived and/or modified sequence from Homo sapiens__NP_005518.3 __HsHSPA1L (opt10)
gggagagucccgcagucggcguccagcggcucugcuuguucgugugugugucguugcaggccuuauucaagcuuaccauggcgacggcgaaggguauagcuauagguauagacuuaggaacgacauacucgugcguaggugucuuccagcacgggaaggucgagaucauagcuaacgaccaggggaacaggacaacgccgaguuacgucgcguucaccgacacugagagauugaucggugacgcggcgaagaaccaggucgcgaugaacccucaaaacacgguauucgacgcgaagcgguuaaucggucgcaaguucaacgacccggucguucaggcggacaugaaguuauggccguuccaaguaauaaacgagggcggaaagccgaagguauugguaucguacaagggugagaacaaggcauucuacccggaagagauaaguucgaugguuuuaaccaaguuaaaggagacagcggaggcguucuuaggucauccgguaacuaacgcgguaaucacgguacccgcuuacuucaacgacagucagcggcaggcgacgaaggacgcgggggucauagcggguuuaaacguauuacgcauaauaaacgagccaacggcagcggcgauagcguacggucuugacaaggggggacagggugagcggcacguauuaaucuucgacuuagguggcgguacauucgacgucucgauauugacgaucgacgacgguauauucgagguaaaggcgacggcgggugacacgcacuuagguggugaggacuucgacaacagauuaguaagucacuucgucgaggaguucaagcggaagcacaagaaggacauaucgcaaaacaagcgcgcuguaaggagauugcggacggccugcgagcgcgcgaagcggacguuaaguucgucgacgcaggcgaaccucgagauagacucguuguacgaggguauagacuuuuacacgaguaucacgcgagcgagauucgaggaguuaugcgccgacuuauuccgcgggacauuggagcccguugagaaggcguuaagggacgcgaagauggacaaggcgaagauccacgacauaguauuagucggugguucgacccgaauaccgaagguacagcgguuauuacaagacuacuucaacggucgcgacuugaacaagucgauaaacccggacgaggcgguagcguacggggcggcaguccaggcggcgauauuaaugggggacaagucggagaagguccaagacuuauuauuguuggacguugcgccguuaaguuuagguuuagagacugcgggcgguguaaugacggcguuaaucaagcggaacucgacaauaccaacgaagcagacgcaaauauucacuacguacagugacaaccagccggguguauugauacagguauacgagggugagcgggcgaugacgaaggacaacaacuuauuaggucguuucgacuuaacugguauaccuccggcuccgcgggggguaccgcaaauagaggucacguucgacauagacgcgaacgggaucuuaaacguaacggcgaccgacaagucgacagguaagguuaacaagauaacuauaacgaacgacaaggguagauuaucgaaggaggagaucgagaggauggucuuggacgcggagaaguacaaggcagaggacgagguacagagagaaaagauagcggcgaagaacgcguuagagaguuacgcguucaacaugaagucgguaguaucggacgagggauuaaaggguaagaucucggagagugacaagaacaagauauuagacaagugcaacgaguuauuaucgugguuggagguuaaccaguuagcggagaaggacgaguucgaccauaagaggaaggaguuagagcaaaugugcaacccgaucaucacgaaguuauaccagggggguugcacggguccggcgugcgguacggguuacgucccugggcgaccggcaacagguccgacgauagaggagguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5839 - RNA, 2196 nt, Artificial Sequence
  mRNA product Design5 comprising derived and/or modified sequence from Homo sapiens__NP_068814.2 __HsHSPA2 (opt10)
gggagagucccgcagucggcguccagcggcucugcuuguucgugugugugucguugcaggccuuauucaagcuuaccaugucggccagggggccggccauagggaucgauuuggggacgacguauagcugugucggggucuuucaacaugggaagguggagaucauagccaaugaucagggcaaucgcacgaccccgaguuacgucgcguucaccgauacggagagguugauaggggaugccgcgaaaaaucaagucgccaugaauccgaccaauaccauauuugaugccaaacgcuugauagggaggaaauuugaggaugccaccgugcagucggauaugaaacauuggccguuuagggucgucagugagggggggaagccgaaaguacagguggaguauaagggggaaaccaaaacguucuuuccggaggaaauaagcucgauggucuugacgaagaugaaggagaucgccgaagccuacuugggggggaaagugcauucggccgucaucaccgugccggccuauuucaaugauucgcagcgccaggccaccaaggaugccgggacgaucaccggguugaauguguugaggaucauaaacgagccgaccgccgccgccauagccuauggguuggauaaaaaggggugugcggggggggaaaagaauguguugaucuuugauuuggggggcgggaccuuugaugugagcaucuugacgaucgaggaugggauauuugaagugaagucgaccgcgggggauacccauuuggggggcgaggauuuugauaauaggauggucucgcacuuggcggaggaauuuaagcgcaaacauaaaaaggacaucgggccgaauaagagagccguccgccgcuugcgcacggccugugagagagccaagcgcacguugucgagcucgacccaggccucgaucgagauagauaguuuguaugagggcgucgauuuuuauacgagcauaaccagagcgagguucgaagaguugaaugcggacuuauuuagggggaccuuggagccgguggagaaggccuugagggaugccaagcucgauaaggggcagauccaggagaucguguuagugggggggaguacgaggauaccgaagauacagaaguuguugcaggauuuuuuuaauggcaaggaguugaauaagagcaucaauccggacgaggccguggcguauggggccgccguccaggccgccaucuugauaggcgauaagucggaaaaugugcaggauuuguuguuauuggaugucacgccguugagcuugggcaucgaaaccgccgggggggucaugacgccguuaaucaagaggaauaccacgaucccgaccaagcaaacgcaaacguuuaccacguauucggauaaucaaagcagugucuuggugcaagucuaugaaggggagagggccaugaccaaggauaauaauuugcucgggaaauuugauuugaccgggauccccccggccccgaggggggucccgcagauagaggugaccuucgauaucgaugcgaaugggauauugaaugucacggccgcggauaagucgaccggcaaagagaauaaaauaaccaucaccaaugauaagggccgcuuaucgaaggaugauaucgauaggauggugcaggaggccgagagguauaagagcgaggacgaagccaaucgcgauaggguggccgccaaaaaugccuuagagagcuauacguauaauauaaaacaaacgguggaggaugagaaguuaagggggaagaucucggagcaggauaagaauaagaucuuagauaagugccaggaggugaucaauugguuggauaggaaucagauggcggagaaggaugaguaugagcauaagcagaaggaguuggagagggucuguaauccgaucauaagcaagcucuaucagggggggccgggggggggcucgggggggggggggaguggggccucgggggggccgacgauagaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5840 - RNA, 2799 nt, Artificial Sequence
  mRNA product Design5 comprising derived and/or modified sequence from Homo sapiens__NP_002145.3 __HsHSPA4 (opt10)
gggagagucccgcagucggcguccagcggcucugcuuguucgugugugugucguugcaggccuuauucaagcuuaccaugucagucguagguaucgaccucgguuuucaaaguuguuacguagcgguagcgcgagcuggagguauagagacgauagcaaacgaauacucggaccgaugcacuccugcgugcauaucguucgggccgaagaacaggucgauaggggccgcggcaaagucgcagguuaucucaaacgcgaaaaacacgguacaggguuucaagcgauuucacggucgugcguucucggacccuuucgucgaggccgagaagaguaacuuagcguacgacauaguucaauuaccgacgggucucacgggcauuaagguaacuuacauggaagaggagcgcaacuucacuacggagcagguaacggcgauguuguuaucgaaguuaaaggaaacggcagagucgguauuaaagaagccagugguagacugcguaguaucaguaccgugcuucuacacggacgcggagcggcguucgguuauggacgccacgcagauagcggggcucaacuguuuacgccuaaugaacgagacgacggccguagcguuagcguacgggauuuacaagcaggacuugccagcgcuugaggagaagccgcgcaacguuguauucguggacaugggacacucggcauaccaggugucggucugcgcguucaaccgggggaagcucaaggucuuagcgacggcguucgacaccacguuaggcggacgcaaguucgacgagguacucguuaaccacuucugcgaggaguucgguaagaaguauaaguuagacauaaagucgaagauucgagcguugcuucguuuaucgcaggagugcgagaaguuaaagaaguuaaugucagcgaacgcgucggacuugccccuuucgaucgagugcuucaugaacgacguagacguuucagggaccaugaacagggggaaguucuuagagauguguaacgacuuauuggcacgagucgaaccucccuugaggucggucuuagagcagacaaaguugaagaaggaggacauauacgcgguagagaucgucggaggggcaacgcguauuccggcaguuaaggagaagauaucgaaguucuucggcaaggaguuaucgacgacgcuuaacgcggacgaggcgguaacgagggguugcgcguuacagugcgcuauacuuucuccagcguucaagguacgcgaguucucgauaacggacguuguuccguaccccaucaguuuacgguggaacucgccggcggaggaggguucgucggacugcgagguguucucgaagaaccacgcggcgcccuucucgaaggucuuaacguucuaccgaaaagagccguucacauuagaggcauacuacaguucgccacaggaccuuccuuacccggacccggcgaucgcacaguucucgguacaaaagguuacgccccagucggacgguucgucgucgaaggucaagguaaaggugaggguuaacguucacgguaucuuuucggucaguucggcgucgcuuguagagguccacaagucggaggagaacgaggagccgauggagacggaccagaacgcgaaagaggaggagaaaaugcagguagaccaggaggagccgcacguagaggagcagcaacagcagacgccggcggagaacaaggcggagucggaggagauggagacuucgcaggcgggcucgaaggacaagaaaauggaccagccuccgcaggcgaaaaaggcgaaggucaagacaucuaccgucgacuuaccgauagagaaccaguuauuguggcaaaucgaccgagagauguuaaacuuauacaucgagaacgaggggaaaaugaucaugcaggacaaguuggaaaaggagcgcaacgacgcgaaaaacgcgguugaggaguacguuuacgagaugcgugacaaguuaucgggcgaguacgagaaguucgucucggaggacgaccgaaacucauucacguuaaaguuggaggacacggagaacugguuauacgaggacggggaggaccaaccgaagcagguauacgucgacaagcuagcggagcuuaagaacuugggacagcccauaaagaucagguuccaagagagugaggagcgcccgaagcuauucgaggaguuagguaagcaaauacagcaguacaugaagaucauaucuaguuuuaagaacaaggaggaccaauacgaccacuuagacgcggcagacaugacuaaggucgagaagaguacgaacgaggcgauggaguggaugaacaauaaguuaaacuuacaaaacaagcagucguuaacgauggacccgguaguaaagucgaaggagaucgaggccaagaucaaggaguuaaccucuacaugcucgccaaucauaucgaagccgaagccgaagguagagccgccgaaggaggagcagaagaacgccgagcaaaacggccccguagacggucagggugacaaccccgggccucaggcggcagaacaggggacggacaccgcgguaccgucugacucggacaaaaaguuaccggagauggacaucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5841 - RNA, 2796 nt, Artificial Sequence
  mRNA product Design5 comprising derived and/or modified sequence from Homo sapiens__NP_055093.2 __HsHSPA4L (opt10)
gggagagucccgcagucggcguccagcggcucugcuuguucgugugugugucguugcaggccuuauucaagcuuaccaugagcgucgucgggaucgauuugggguucuugaauuguuauauagccguggcccgcucgggggggauagaaacgauagcgaacgaauauucggaucgcuguacgcccgcgugcaucagccucgggagccgcaccagggcgauagggaacgccgccaaaucgcaaaucgugaccaauguccgcaacaccauccacggguuuaagaaauugcacggcaggagcuucgacgauccgaucguccagaccgagcgcauacgcuugccguacgaauuacaaaagaugccgaacgggucggccggggucaaagucagauaucucgaagaggaacgcccguucgccaucgaacaagucaccgggauguuacucgcgaaauugaaggaaaccagcgagaacgcccucaaaaagccggucgccgauugcgucaucagcaucccgucguuuuucaccgacgcggaacgccgcagcgucauggccgccgcgcaagucgccgggcucaacugccuccgccucaugaacgagaccaccgccgucgccuuagccuacgggaucuacaagcaagacuugccgccgcucgacgaaaagccgcgcaacgucgucuucaucgacauggggcauagcgcguaccaagugcucgucugcgccuuuaauaaagggaaguugaaggugcucgccaccacguucgacccguaccucggggggcgcaauuucgacgaagcccucgucgauuauuuuugcgacgaauuuaaaacgaaguacaaaaucaacgucaaggagaauagcagagcgcuccucaggcucuaccaagaaugcgagaaguugaaaaaauugaugucggccaacgccagcgacuugccgcucaauaucgaaugcuuuaugaacgauuuggacgucagcucgaagaugaaucgcgcccaguucgaacaauuaugcgccaguuugcucgcgcgcgucgagccgccgcucaaagccgucauggagcaagccaaucuccaaagggaggauaucucgucgaucgagaucgucgggggggccaccaggaucccggccgucaaggagcaaauaaccaaguuuuucuugaaggauaucucgacgacccucaacgccgacgaggccgucgcccgcgggugcgcccuccaaugcgccaucuugagcccggccuucaaggucagggaguucaguaucaccgauuuggucccguacagcauaacccuccgcuggaaaacgagcuucgaggacgggucgggcgagugcgaggucuuuugcaaaaaucauccggcgccguuuagcaaagugaucaccuuucauaaaaaagagccguucgaguuggaggccuucuacaccaaccuccaugaggucccguauccggacgcccgcaucggcucguuuaccauccaaaacgucuucccgcaaagcgacggggacucgaguaaggucaaagucaaggucagggucaauauacacgggauauuuucggucgccucggccagcgucaucgaaaaacagaaccucgagggggaccauucggacgccccgauggaaaccgagaccagcuucaagaacgagaauaaggacaacauggacaagaugcaagucgaccaagaggagggccaccagaagugccacgccgagcauaccccggaggaagagaucgaccauaccggggcgaagaccaaaagcgccgugagcgauaagcaagauaggcucaaccaaaccuugaagaaggggaaaguaaagucgaucgacuugcccauacaaucgucguugugccgccaauuggggcaagacuuguuaaauucguauaucgagaacgaaggcaaaaugauaaugcaagacaaacucgaaaaggagcgcaacgacgccaaaaacgcggucgaggaguacgucuacgacuuccgcgaucgcuuagggaccguguacgagaaguuuauaaccccggaagaucucucgaaauuaagcgccguccucgaggauaccgaaaacugguuguacgaggauggggaagaucaaccgaagcaggucuacgucgacaaauugcaggaguugaaaaaguaugggcaaccgauccaaaugaaauauauggaacacgaagaacgcccgaaggcgcucaacgaucucgggaaaaaaauacaauuggugaugaaagucaucgaagccuaccgcaauaaagacgagcgcuacgaccacuuagacccgaccgaaauggagaaagucgagaagugcauaucggacgcgaugucgugguuaaacucgaaaaugaacgcccaaaauaaguugucguugacccaggacccggucgucaaggucagcgagaucgucgccaaaagcaaagaguuagacaacuuuugcaauccgauaaucuauaaaccgaaaccgaaggccgaggucccggaggauaagccgaaggccaacucggaacauaacgggccgauggacgggcaaucggggaccgagaccaagagcgacagcaccaaggauucgagccaacacaccaaaaguagcggggaaauggaggucgauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5842 - RNA, 2241 nt, Artificial Sequence
  mRNA product Design5 comprising derived and/or modified sequence from Homo sapiens__NP_005338.1__HsHSPA5 (opt10)
gggagagucccgcagucggcguccagcggcucugcuuguucgugugugugucguugcaggccuuauucaagcuuaccaugaaauugaguuuagucgcggccauguuauuauuauugucggccgccagagcggaagaagaagauaaaaaagaagaugucgggaccgucguggggauagauuuaggcacgacguauaguugugugggggucuuuaaaaaugggagggucgaaauaauagcgaaugaccaagggaauaggauaacccccaguuacguggcguuuaccccggagggcgagagguuaaucggggacgcggcgaaaaaucaauugacgaguaauccggaaaauaccguguucgaugcgaaaagauugauagggaggaccuggaacgaucccagcguccaacaagauauaaaauuucuccccuuuaaagucgucgagaaaaagaccaagccguauauccaggucgacaucggggggggccagaccaaaaccuucgccccggaggagaucagcgcgauggucuugaccaagaugaaggagacggccgaagccuaccucgggaaaaaagucacgcacgccgucgucaccgucccggcguacuucaacgacgcgcagaggcaggccacgaaggaugccgggaccaucgccggguugaacgucaugcgcauaauaaaugaaccgaccgccgccgccaucgccuacggguuagacaaacgcgaaggcgaaaaaaauauauuagucuucgauuuagggggggggacguuugacgucagcuuguugacgaucgauaacgggguguuugaggucgucgcgaccaacggggacacccacuuagggggggaggauuucgaucaaagggugauggagcauuuuauaaaguuauauaagaaaaaaaccgggaaggacgugcgcaaggauaaccgcgccguccaaaaguugagaagggaagucgagaaagcgaagagagcguuaagcagccaacaccaggcccgcaucgagaucgaaaguuuuuacgagggggaggauuucagcgaaacguuaaccagagcgaaguucgaggaauugaauauggacuuauuuagaagcaccaugaaaccggugcaaaagguccucgaggacagcgaccucaaaaaaagcgacaucgacgagaucgucuuggucggggggagcaccaggaucccgaaaauccaacaguuagucaaggaauuuuuuaacgggaaagagccgaguagggggaucaauccggacgaggccgucgccuacggggccgccgugcaagccggggucuugagcggggaccaggacaccggggauuuagucuuauuggacgucugcccguugaccuuggggaucgagaccgucgggggggugaugacgaaguuaaucccgcgcaauaccgucgucccgacgaaaaaaagccaaauauucagcaccgccagcgacaaccagccgaccgucaccauaaaaguguacgagggggagcgcccguuaaccaaggauaaccacuuguuagggaccuucgacuuaaccgggaucccgccggccccgaggggcgugccgcaaaucgaggugacguucgaaaucgacgucaacgggaucuugagggucaccgccgaggauaaagggaccggcaauaagaacaaaauaaccauaacgaacgaucaaaacagguuaaccccggaggagauagagcgcauggucaacgacgccgaaaaauucgccgaagaggauaagaaauugaaagaaaggaucgacacccgcaacgaacucgagucguacgcguacagcuugaaaaaccaaaucggggacaaggagaaauuaggggggaaguugaguagcgaggacaaagaaacgauggagaaggccgucgaggagaaaaucgagugguuagagucgcaucaggacgccgauaucgaggauuuuaaggccaaaaaaaaagaguuagaggagaucguccagccgaucauaucgaaguuguacgggucggccgggccgccgccgaccggggaggaagacaccgccgagaaggacgaacucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5843 - RNA, 2208 nt, Artificial Sequence
  mRNA product Design5 comprising derived and/or modified sequence from Homo sapiens__NP_002146.2__HsHSPA6 (opt10)
gggagagucccgcagucggcguccagcggcucugcuuguucgugugugugucguugcaggccuuauucaagcuuaccaugcaagcgccgagagaauuggccgucgggauagauuuagggacgacguauagcugugucggggucuuccaacaagggagggucgaaauauuagcgaaugaucaagggaauaggacgaccccgucguaugucgcguuuacggauacggaaagauuagugggcgaugccgcgaaaucgcaagccgcguuaaauccgcauaauacggucuuugacgcgaaaagauuaauaggcaggaaauuugccgauacgaccguccaaagcgauaugaaacauuggccguuuagagucgucucggaaggggggaaaccgaaagucagggucuguuauaggggcgaagauaaaaccuuuuauccggaagaaauaagcaguauggucuuaucgaaaaugaaagaaaccgcggaagccuauuuagggcaaccggucaaacaugccgucauaacggucccggcguacuuuaacgauagccaaaggcaagcgacgaaagaugccggcgcgauagccggcuugaauguccucagaauaauaaacgaaccgaccgccgccgcgauagcguacggcuuagauagaagaggggccggggaaaggaaugucuugaucuucgauuuagggggcgggacguuugacgucagcgucuugaguaucgaugccgggguguucgaagucaaggcgaccgccggggacacgcauuuagggggggaagauuuugauaauagauuggucaaucauuuuauggaggaguuuagaagaaaacacggcaaagauuuaucgggcaauaaaagggcguuaaggcgcuuaaggaccgcgugcgaaagggcgaaaaggacguuaaguaguucgacgcaagcgacguuagaaaucgauaguuuauuugaaggggucgauuuuuauaccaguauaaccagggcgagguucgaagaguuauguagcgauuuguuuaggucgacguuagaacccgucgaaaaagcguuaagagacgcgaaauuagauaaagcgcaaauccacgaugugguguuagucggcgggaguaccaggauaccgaaaguccaaaaacucuuacaagauuuuuuuaaugggaaagaauuaaauaaaucgauaaauccggacgaagccgucgcguacggcgccgccguccaagccgcgguccucaugggcgauaagugcgaaaagguccaagacuuguuauuauuagacgucgccccgcucagcuuaggcuuagaaaccgccgggggcgucaugacgaccuuaauacaacgcaaugcgaccauaccgacgaaacaaacgcaaaccuuuacgacguauagcgauaaucaaccgggcguguuuauacaagucuacgaaggggaacgcgcgaugacgaaagauaauaauuuauuaggcagguucgaguugucggggauaccgccggcgccgaggggggugccgcaaaucgaagucaccuucgauaucgacgccaacgggauauuaucggucaccgcgaccgaucgcucgaccgggaaagccaauaaaauaacgauaacgaacgauaaagggagauuaucgaaagaagaagucgaacgcaugguccacgaggcggaacaauauaaagccgaagacgaagcgcaacgcgaucgcgucgccgcgaagaauagcuuagaagcgcacguguuucacgucaaggggagccuccaggaagagucguugcgcgauaaaaucccggaggaagaucgcaggaagaugcaggauaaaugcagagagguguuggcgugguuagaacauaaucaauuagccgaaaaagaagaauacgaacaccaaaaacgcgaauuagaacagauaugcaggccgauauuuagucgcuuguacggcggcccgggggugccgggcgggucgucgugcgggacccaggcgaggcaaggcgauccgucgacggggccgauaaucgaagaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5844 - RNA, 1380 nt, Artificial Sequence
  mRNA product Design5 comprising derived and/or modified sequence from Homo sapiens__P48741__HsHSPA7 (opt10)
gggagagucccgcagucggcguccagcggcucugcuuguucgugugugugucguugcaggccuuauucaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagucgcaggccgcgcucaacccccacaacacgguguucgacgccaagcgcuuaaucggccggaaguucgccgacaccaccguccagagcgacaugaagcacuggcccuuccagguggugucggagggcgggaagcccaaggucagggugugcuaccggggcgaggacaagaccuucuacccggaggagaucagcagcaugguguuauccaagaugaaggagacggccgaggcguaccucgggcagcccgucaagcacgccgugaucaccgugcccaccuacuucucgaacagccagaggcaggccaccaaggacgccggcgccaucgcggggcugaaggucuuacccaucaucaacgaggccacggccgccgccaucgcguacggccucgacagacgcggcgccgggaagcggaacgugcugaucuucgacuuaggcgggggcaccuucgacgugagcgucuugaguaucgacgccggcguguucgaggugaaggccaccgccggggacacccacuuaggcggggaggacuucgacaaccgccuggucaaccacuucauggaggaguucagacgcaagcacggcaaggaccucucggggaacaagcgggcguuaaggcgguuaaggacggccugcgagcgggccaagaggaccccgaguagcuccacccaggccacccucgagaucgacagcuuauucgagggcguggacuucuacaagaguaucacgcgggccagguucgaggaguuaugcagcgacuuguucagguccaccuuagagcccguggagaaggcguuaagagacgccaagcucgacaaggcccagauccacgacuucgucuuaggcgggggccugcacagccacccccagggggccgagguggcggccggccuccugcagcgccagggggccgagcaggagcaccagcccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5845 - RNA, 2217 nt, Artificial Sequence
  mRNA product Design5 comprising derived and/or modified sequence from Homo sapiens__NP_006588.1 __HsHSPA8 (opt10)
gggagagucccgcagucggcguccagcggcucugcuuguucgugugugugucguugcaggccuuauucaagcuuaccaugucgaaggggccggcgguagguauagacuuaggcacgacguacucgugcguagggguauuccagcacggcaagguagagaucaucgcgaacgaccaggggaaccgaacaacgccgucguacguagcauucaccgacacggagcgcuuaauaggcgacgcggcgaagaaccagguagcgaugaacccgacuaacacggucuucgacgcgaagcgguuaaucggucgacgguucgacgacgcgguaguacagucggacaugaagcacuggcccuucauggucguuaacgacgcagguagaccgaagguacagguggaguacaagggcgagaccaagucguucuacccggaggaggucucgucgaugguguuaaccaagaugaaggagaucgcggaggcguacuuggguaagacggugacgaacgcagucguuacggucccggcguacuucaacgacagucagcgacaggcgacuaaggacgcggguacgaucgcgggauuaaacgucuuacgaaucaucaacgagccgacggcggccgcgauagcguacgggcuagacaagaagguaggugcggagaggaacguauuaaucuucgacuuggggggcgggacguucgacguaucgauauuaaccaucgaggacgguauuuucgagguaaagaguaccgcaggggacacccacuuagggggggaggacuucgacaaccguaugguaaaccacuucauagcggaguucaagcggaagcacaagaaggacauaucggagaacaagcgcgccguacgacguuuacggacggcgugcgagagagcgaagcgaaccuuaaguucgaguacucaggcaucgauagagauagacucguuauacgaggggaucgacuucuacacgucgaucacgcgagcgcgguucgaggaguugaacgccgacuuguuccgagggacgcuugacccgguggagaaggcguuacgggacgcuaaguuagacaagagucagauacacgacauaguauuaguaggggggucgacgcgaaucccuaagauacagaaguuauugcaggacuucuucaacggcaaggaguuaaacaagaguauaaacccggacgaggcaguagccuacggggcggcgguacaggcggcgauucucucgggugacaagucggagaacgugcaggacuuauuauuauuagacguaacgcccuuaucgcucgggaucgagacggcgggggggguaaugacgguauugaucaagaggaacacgacgauaccgacgaagcaaacgcagacguucacgaccuacucggacaaccagccgggcguauuaauacagguauacgagggcgagcgggccaugacgaaggacaacaaccuuuuagguaaguucgaguuaacggguauuccgccggcgccgagggggguaccgcaaaucgagguaacguucgacauagacgcgaacgggauccuuaacguaagugcgguagacaagucgacggguaaggagaacaagaucacgauaacgaacgacaagggccgcuuaaguaaggaggacaucgagcgcaugguacaggaggcggagaaguacaaggcggaggacgagaagcagcgagacaagguaucgucgaagaacucguuggagaguuacgcguucaacaugaaggcgacgguagaggacgagaaguuacaggguaagaucaacgacgaggacaagcagaagaucuuggacaagugcaacgagauaaucaacugguuagacaagaaccagacggcggagaaggaggaguucgagcaccagcaaaaggaguuagagaagguaugcaacccgaucauaacgaagcuauaccaguccgcgggugggaugccgggggggaugccgggcgguuuccccggagggggugccccgccgagugggggggcgucgucgggcccgacgaucgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5846 - RNA, 2316 nt, Artificial Sequence
  mRNA product Design5 comprising derived and/or modified sequence from Homo sapiens__NP_004125.3 __HsHSPA9 (opt10)
gggagagucccgcagucggcguccagcggcucugcuuguucgugugugugucguugcaggccuuauucaagcuuaccaugaucucggcgucgagggccgccgccgcgagguuggucggggcggccgcgaguagagggccgaccgcggcgaggcaucaagacucguggaacggguugucgcacgaagccuuccgcuuggucagccgcagagacuacgccagcgaggcgauaaaaggggccgucgucgggaucgaucucgggaccacgaauaguugugucgccgucauggaggggaagcaagcgaaagucuuagaaaacgcggagggggcgcgcacgacgccgagcgucgucgcguucaccgccgacggggaaagguuggucgggaugcccgcgaaaaggcaagccgugacgaauccgaauaauaccuucuacgccacgaaaagguugaucgggagaagguacgacgacccggagguccaaaaggauaucaagaacgucccguuuaagaucgugagggcgaguaacggggacgcgugggucgaagcccauggcaagcucuacagccccucgcaaauaggggccuucguccucaugaaaaugaaggaaaccgccgagaacuaucucggccauaccgccaagaacgccgucauaaccgugccggccuacuuuaacgauagccaacgccaagcgaccaaagacgccgggcaaauuagcggguuaaacgucuugagagucaucaacgaaccgaccgccgccgccuuggcguacggguuggauaagagcgaggauaagguaaucgccgucuacgaccucgggggggggaccuucgacaucagcauauuagagauccaaaagggggucuucgaagucaagaguaccaacggcgacacguuucucgggggcgaggauuucgaucaagcgcucuugagacauaucgucaaagaauuuaaacgcgaaaccggcgucgaccucaccaaagauaauauggccuugcaacgcgucagagaggccgccgagaaagccaagugcgaguugaguagcagcguccaaaccgauauaaaccucccguacuugaccauggacagcagcgggccgaaacaccucaacaugaaacucacgagggcccaguucgagggcaucgugaccgacuugauacgccgcaccauagccccgugucaaaaggccaugcaggacgccgagguaucgaaaucggauaucggggaggucauauuggucggggggaugacccgcaugccgaaaguccaacaaaccguccaagauuuguucgggcgcgcgccgucgaaagccgugaacccggacgaagccgucgcgaucggggccgcgauccaaggggggguccucgcgggggacgugaccgacgucuuauuguuggacgugaccccgcucagcuuagggaucgagaccuugggggggguguucacgaaguugaucaaccgcaacacgaccaucccgacgaaaaaaucgcaagucuuuagcaccgcggccgacgggcagacccaggucgagaucaaggucugucaaggggagcgcgaaauggccggggauaauaaguuguuggggcaauucacccucaucgggaucccgccggcgccgaggggggucccgcaaaucgaggucaccuucgauaucgacgcgaacggcaucguccacgucagcgccaaggacaaggggaccgggagggaacaacaaaucgucauacaaagcagcggggggcucucgaaggacgacaucgagaacauggucaaaaacgccgaaaaauacgccgaggaggauagaaggaaaaaagagagggucgaggcggucaauauggccgaggggauaauccaugauaccgaaacgaaaauggaagaguuuaaagaucagcucccggccgacgaauguaauaaauuaaaggaggaaaucaguaagaugcgcgaauuguuagcccgcaaagauucggaaaccggggagaacauccgccaagccgcgaguagcuugcaacaagccagcuuaaaauuauuugagauggccuauaaaaaaauggccagcgaaagggaggggagcgggucgagcgggaccggcgagcaaaaagaggaccagaaagaagagaaacaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5847 - RNA, 2304 nt, Artificial Sequence
  mRNA product Design5 comprising derived and/or modified sequence from Homo sapiens__NP_079291.2__HsHSPA12A (opt10)
gggagagucccgcagucggcguccagcggcucugcuuguucgugugugugucguugcaggccuuauucaagcuuaccauggcagacaaggaagcaggggguucggacggcccucgugagacugcaccuacuucggcguacucuucgccggcucgaucguuaggugacacugggaucacgccguuaaguccgucgcacauaguaaacgauacggacaguaacguaucggagcagcagucguucuuaguaguaguagcgguggacuucgguaccacgucgucggguuacgcguacucguucacgaaagagccggagugcauacacgucaugcggaggugggaggggggagacccgggcguaaguaaccagaagacaccuacgacgauauuauuaacgccggagcggaaguuccacucguucgguuacgcggcccgugacuucuaccacgacuuagacccaaacgaggcaaagcaaugguuauacuuggagaaauucaaaaugaaguuacacacuacgggagacuuaacgauggacacugacuugacugccgcgaacgguaaaaagguaaaggcgcucgagaucuucgcguacgcauuacaguacuucaaggagcaggccuuaaaggagcucucugaccaggcugggucagaguucgagaacagugacguaagguggguaauaacuguaccggcgauauggaagcagccagcgaagcaguucaugcgccaggcagcguaccaggcgggguuagcgucgccggagaacagugagcaguuaauaaucgcuuuagaaccggaagcggcgucgauauacugccggaaguuacguuuacaccaaaugauagaguuaucaaguaaggcggcgguuaacggguacucagguucggacacuguuggggcggguuucacgcaggcgaaggagcacauccgacgaaacaggcaaucgcgcacauuccucgucgagaacguuauuggcgagauuuggagugagcuugaggagggagacaaguacguaguaguagacucgggugggggaacuguugauuuaacgguacaccaaauuaggcucccagagggucacuuaaaggagcucuacaaggccacgggugguccguacgguagucucgggguugacuacgaguucgagaaguugcucuacaagaucuucggugaggacuucauagagcaguuuaagaucaagcguccggcggcguggguagaccucaugauagcuuucgaaucgcgaaagcgcgccgcagcgccggaccgaacgaacccuuugaacaucacguuaccguucucguucauagacuacuacaagaaguuccguggacacucgguagagcacgcguuacgaaagaguaacguagacuucguaaaguggucgagucaggguaugcuucgcaugucgcccgacgcgaugaacgcguuauucaagccuacuaucgacucgauaauagaacacuugagggacuuauuccagaagccggagguaucgacgguaaaguucuuauucuuagucgggggguucgcagaggcgccguuguuacagcaggcaguucaggcggcguucggugaccagugccgaauaauaauaccccaggacguaggguuaacgaucuugaagggggcgguuuuauucggguuagacccggccguaauaaagguucgacguucacccuugacuuacggugucggcgucuuaaaccgauacguagaggggaagcacccaccggaaaaguuguuagucaaggacggaacacgauggugcacggacguauucgacaaguucauaucggccgaccaaaguguagcguuaggcgaguuaguaaagcgaucguauacgccugccaagccgucgcaauuaguaauagucaucaacaucuacaguucggagcacgacaacguaaguuuuauaacggacccgggagucaagaagugcggaacauuaagguuagacuugacggguacgucggguaccgcgguuccagcgcgccgagagauacagacgcucaugcaguucggugacacggagauaaaggcgacggcgauagacaucgcuacgucuaagucgguaaaggucgguaucgacuuucucaacuacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5848 - RNA, 2337 nt, Artificial Sequence
  mRNA product Design5 comprising derived and/or modified sequence from Homo sapiens__NP_443202.3 __HsHSPA12B (opt10)
gggagagucccgcagucggcguccagcggcucugcuuguucgugugugugucguugcaggccuuauucaagcuuaccauguuagcaguacccgagaugggauuacaagguuuauacauagguucgucgcccgagcguucgccgguuccgucgccuccggggucgccacgcacgcaagagucgugcgggauagcaccuuuaacuccuucccagaguccuaagccggaaguucgugcaccgcagcaggcaucguucagugucguagucgcuauagacuucgguacaacaucgucggguuacgccuucucguucgcuucggacccggaggcaauccauaugaugcguaagugggaggguggugacccuggugucgcgcaccaaaagacgccuacgugcuuauuauuaacgccugagggggcguuccacucguucggauacacggcgcgagacuacuaccacgacuuggaccccgaggaggcucgcgacugguuauacuucgaaaaguucaaaaugaagauacacucggcgacugacuuaacguuaaagacacaacucgaggcgguuaacgggaagacaaugccggcguuagaggucuucgcgcacgcguugagguucuuccgcgagcacgcgcuccaggaguuacgagagcaaucgccgucauugccggagaaagacacgguccguugggucuuaaccgucccggcgaucuggaagcaaccggcgaaacaguucaugcgagaggcggcuuauuuagcgggguuaguaucgcgugagaacgcggagcaauuauuaauagcguuagagccggaggcggcgucaguuuacugucgaaaguugcgauugcaccaguuguuagauuuaucaggaagggcgccgggaggcgggcgauugggcgagaggcgaucgauagacucgucguuccgacaggcgcgcgagcagcuccgucguucgaggcauucgcggacguucuuaguagagucggguguuggugaguuaugggcggaaaugcaggcgggugaccguuacguagucgcugacugcgguggggggacgguagacuuaacaguucaccaguuagagcagccacacgguacguugaaagagcuuuacaaggcgucaggagggccguacggggccguagggguugauuuagcguucgagcaguugcucugccggaucuucggcgaggacuucaucgcaacauucaagcgccagcguccagcggcaugggucgacuuaacaauagcguucgaggcacguaagcggacggcaggaccgcaucgagcgggugcauuaaacauaaguuuaccguucucguucauagacuucuaccggaagcaacgcggucacaacguagagacggcgcucaggcgaaguucggucaacuucguaaaguggaguucgcaggguauguugcgcaugaguugcgaggcgaugaacgaguuauuccagccaacaguuucaggcauuauacagcacauugaggcauuauuggcgcgccccgagguacagggggucaagcucuuauucuuggucggaggauucgcggagucggcaguauuacagcacgcaguacaagcggcuuuaggugcgaggggcuuacgcguaguaguaccccacgacgucgguuugacuauauugaagggcgccguuuuauucggucaggcuccgggagucgucaggguucgacggucuccauuaacuuacggugucgguguauuaaaccguuucguccccgguaggcacccgccggagaaguuauugguacgagacggucgaagguggugcacggacguguucgagcguuucguagcagcggaacagucagucgcguuaggagaggagguaaggcguucguacuguccugcaaggccaggacagcgucgagucuuaauuaacuuguauuguugcgcagcggaggacgcacgauucauaacugacccggguguacggaagugcggugccuuaaguuuggaguuagaaccggcggacugcggucaggacacggcgggugcaccaccgggucgucgagagauccgagcagcgaugcaauucggugauacugagauaaaggugacggcgguagacguuucgacuaacaggucgguccgagcaucgaucgacuucuuaucgaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5849 - RNA, 1692 nt, Artificial Sequence
  mRNA product Design5 comprising derived and/or modified sequence from Homo sapiens__NP_008879.3__HsHSPA13 (opt10)
gggagagucccgcagucggcguccagcggcucugcuuguucgugugugugucguugcaggccuuauucaagcuuaccauggcgcgcgaaaugacuauacucgggucugcggucuuaacguuacucuuagcagguuacuuagcgcagcaguaccuuccucuuccgacacccaagguaauaggaauagacuuagguacgacauacugcagugucggaguauucuucccgggaacugguaaggucaagguaauaccggacgagaacggacacaucucuaucccgucgauggucucguucacggauaacgacguuuacgucggguacgagucggucgaguuagcggacucuaacccgcagaacacgaucuacgacgcuaagcgauucaucgguaagauauucacggcggaggaguuagaggcagagauagguagguacccguucaaggucuugaacaagaacgggaugguagaguucucaguaaccucgaacgagacgaucacuguaagucccgaguacgucgguucacguuuacuauuaaaguugaaggagauggcggaggcguacuugggcaugccgguagcgaacgcaguaauaucgguccccgccgaguucgacuuaaagcaacgaaacucgacgaucgaggcggcgaacuuagcggggcuuaagauccuucgagugaucaacgagccgacggcggcggcgauggccuacggguuacacaaggccgacguauuccacgugcuugucaucgacuuaggaggugggacacucgacgucucgcuuuugaacaagcaggguggaauguucuugacgcgugcgaugucggguaacaacaaguugggugggcaggacuucaaccagcgauuauuacaguacuuguacaagcaaauuuaccagacguacgguuucgucccgucacgaaaggaagagauacaucgauuaaggcaggcagucgagaugguaaaguugaacuugacguuacaccagucggcgcaauuaagugucuuguuaacgguugaggagcaggaccguaaggagccgcacucgucggacaccgaguuaccgaaggacaaguugucgucggcugacgaccacaggguaaacucggguuucggcagggguuuaucagacaagaagucgggcgagucgcagguacucuucgagacggagaucagucgaaaguuauucgacacguuaaacgaggacuuauuccaaaagaucuuaguuccgauccagcagguuuuaaaggagggucacuuagagaagacggagauagacgagguugucuuggucggugguucgacgcgaaucccccgaaucaggcagguaauacaggaguucuucgggaaggacccaaacacgucggucgauccggacuuagcgguuguuaccgguguugcgauucaggccgggauagacggggguucguggccguuacagguaucagcgcucgagauaccgaacaagcacuugcagaagacgaacuucaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5850 - RNA, 1806 nt, Artificial Sequence
  mRNA product Design5 comprising derived and/or modified sequence from Homo sapiens__NP_057383.2__HsHSPA14 (opt10)
gggagagucccgcagucggcguccagcggcucugcuuguucgugugugugucguugcaggccuuauucaagcuuaccauggccgcgauagggguccauuuaggguguacgagcgcgugcgucgcgguguacaaagacgggagagccggggucgucgccaacgacgcgggggauagggucaccccggccgucgucgccuauagcgagaacgaggaaaucgucgggcucgccgccaagcagucgcgcauccgcaacaucagcaauaccgucaugaaggucaaacaaauauuagggcgcucgaguucggauccgcaggcgcaaaaguauauagccgagucgaagugccucgugaucgaaaagaacggcaagcucagguacgagaucgacaccggggaggagaccaaguucgucaauccggaggacgucgcgcgcuuaauuuuuucgaaaaugaaggagaccgcccacagcguccucgggagcgacgccaacgacgucgucaucaccgugcccuucgacuucggggaaaaacagaagaacgccuugggggaggccgcccgcgccgccggguucaacguccucaggcucauccaugaacccagcgccgccuuguuggccuacgggaucgggcaggauaguccgaccgggaagucgaacauccucgucuuuaaauugggggggaccagucucagcuugucggugauggaggucaauucggggaucuacagagucuugagcacgaauaccgacgacaauauagggggggcccauuuuaccgagacgcucgcccaauacuuggccagcgaauuucagcgcaguuuuaagcacgacguccgcgggaacgccagggcgaugaugaagcucaccaauucggccgaggucgccaaacacagccucagcacgcucgggucggcgaauugcuuuuuggauagccucuacgaggggcaggacuucgacuguaacgucagucgcgcccgcuucgaguuguugugcagcccguuguucaacaaaugcaucgaggccauacgcggguugcucgaccagaacggguuuaccgccgacgacauaaauaaagucguguugugcgggggcagcagcaggauaccgaaauugcaacaauuaaucaaggacuuguuuccggccgucgaauuguugaacagcauaccgccggacgaggucauaccgaucggggccgccaucgaggccgggaucuugaucggcaaggagaauuuacucgucgaagauagcuugaugaucgaaugcagcgcgcgcgacauccucgucaaaggggucgaugagagcggggcgucgcgcuuuaccgucuuauucccgagcggcaccccgcucccggccaggcgccagcauacccuccaagcgccggggucgaucagcagcgucuguuuggaguuguacgaaagcgacggcaaaaauagcgcgaaagaagagacgaaauucgcccaagucgucuugcaagaucucgauaagaaggagaacgggcucagggacauccucgccgucuugaccaugaagcgcgacgggagccuccacgucaccuguaccgaccaagaaaccgggaagugcgaggccauaagcaucgaaaucgccagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5851 - RNA, 2853 nt, Artificial Sequence
  mRNA product Design5 comprising derived and/or modified sequence from Homo sapiens__NP_006635.2 __HsHSPH1 (opt10)
gggagagucccgcagucggcguccagcggcucugcuuguucgugugugugucguugcaggccuuauucaagcuuaccauguccgugguaggacucgacgucgggagccaaagcugcuacauagcgguagccagggcaggcgggauagagacgaucgccaacgaguucuccgaucgcugcacacccagcgucaucagcuuugguucuaaaaacaggacuauaggaguggccgcgaaaaaccaacaaauaacccaugcaaacaacaccgucagcaacuucaaacgauuccacggacgugccuucaacgacccguuuauacaaaaagaaaaagaaaaccuauccuacgaccuagucccccucaagaauggaggcgugggcaucaaaguuauguauaugggagaagaacacuuguucucaguagaacagauaaccgccaugcuacuaacaaaacugaaggaaaccgcagagaacagucugaagaaaccugucaccgacugcguaaucuccguacccuccuucuucaccgacgcagaacggagauccguacuagacgcagcccaaauaguaggccuaaacugccuccgcuugaugaacgauaugacggccguagcacucaacuaugggauuuacaaacaagaccucccaagccucgacgaaaaaccccgcauaguagucuucgucgacaugggacacucagcauuccagguaagcgcaugcgccuucaacaaaggaaaacucaaagucuuaggcacggcuuucgaccccuuccuaggcgggaaaaauuucgacgagaaacucgucgaacacuucugcgccgaguucaaaaccaaauacaaacucgacgcaaagagcaaaauccgagcccuccuacgcuuauaccaggaaugcgaaaagcuaaagaaauugauguccuccaacuccaccgaccuacccuuaaacaucgaauguuucaugaacgacaaggacgucagcggaaagaugaacagaucccaguucgaggagcucugcgccgaguuauuacaaaagauagaagucccccucuacagccuucucgaacagacccaccucaaaguagaagacguuucagccgucgaaaucgucggcggagcaacacgcauccccgcggucaaagaacgcaucgccaaauucuucgggaaggacauauccaccacccuaaacgcagacgaagcaguggcacgcgggugugcccuccagugcgccaucuuaagccccgcauucaaaguacgagaguucucaguaaccgaugccgucccguucccaauaagccugauauggaaccacgacagcgaggacaccgaagguguccacgaagucuucagucgaaaccacgcggccccauucucaaaaguauuaacguuccuccgacgcggacccuucgaacucgaagcauucuacagcgacccgcaaggcguaccguacccugaggcaaagauuggcagguucguaguccagaacgucuccgcacaaaaagauggcgagaaaagccgcguaaaggucaaaguccgagucaauacacacggaaucuucaccauuuccaccgccucaaugguagaaaaaguccccacagaagaaaacgagaugagcucugaagccgacauggagugccucaaccaacgcccacccgaaaaccccgacaccgacaagaacguccaacaagacaacagcgaagcaggaacccagccccaaguccaaaccgacgcacaacagaccagccagagcccacccucccccgagcucacaucagaagaaaauaagaucccagacgcagacaaggccaacgaaaagaaagucgaccagcccccggaggccaagaaacccaaaaucaaaguggucaacguagaacuccccaucgaagcaaaccuggucuggcagcuagguaaagacuuauuaaacauguacaucgaaaccgaaggcaaaaugauaaugcaagauaaacucgaaaaagaacgcaacgacgccaaaaacgcagucgaagaauacguauacgaguuccgggacaaauuaugcggcccauacgaaaaauucaucugugaacaagaccaccaaaacuuucuacguuuauuaaccgaaaccgaagacuggcucuacgaagaaggcgaagaucaagcaaaacaggcuuacgucgauaaacucgaagaacuaaugaaaaucggaacgccggucaaagugcgguuccaagaagcagaagaacgucccaaaauguucgaggaacucggacaaagacuccaacacuacgcgaaaaucgccgccgacuuccgcaacaaagacgagaaguacaaccacaucgacgaaucagaaaugaagaaaguagaaaagucggucaacgaaguaauggaauggaugaacaacguaaugaacgcccaagccaaaaagucccucgaccaagacccagucguccgagcacaagaaaucaaaaccaaaauuaaggaacucaacaauaccugcgagcccgucguaacgcaaccgaaaccaaaaauagaaucccccaaacucgaacgaacccccaacgggccgaacaucgacaagaaagaagaagaccucgaggacaaaaacaacuucggagcagaaccaccacaccaaaacggcgaaugcuacccaaacgagaaaaacagcgucaacauggaccucgauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5852 - RNA, 3276 nt, Artificial Sequence
  mRNA product Design5 comprising derived and/or modified sequence from Homo sapiens__NP_006380.1 __HsHYOU1 (opt10)
gggagagucccgcagucggcguccagcggcucugcuuguucgugugugugucguugcaggccuuauucaagcuuaccauggccgauaagguccgccgccaacgcccccgccgcagggugugcugggcgcucgucgccgucuugcucgccgauuuacucgccuuaucggacaccuuagccgucaugagcgucgauuuagggucggaaaguaugaaagucgcgaucgugaagccgggggucccgauggagaucgugcucaacaaagagagcagacgcaagacccccgucauagucacguuaaaggagaacgagcgcuuuuucggggauucggccgccucgauggccaucaaaaacccgaaagccaccuugagguauuuucaacauuuguuaggcaaacaagccgacaauccgcacgucgccuuguaucaagcgagguuucccgaacaugaauuaaccuuugauccgcaacgccaaaccguccauuuccaaauaucgagccaauuacaauuuagcccggaagagguccucgggauggucuugaacuacagcaggagcuuggccgaggacuucgccgaacaaccgauaaaagacgccgucauaacggucccgguguuuuuuaaucaagcggaaaggagggccgucuuacaagccgccaggauggccggguugaaggucuuacaauugauaaacgauaauacggcgaccgcguugucguacgggguguuuaggagaaaggacaucaauacgaccgcgcaaaacauaauguuuuacgauauggggagcgggucgacggucuguacgaucgucacguaucaaauggucaaaaccaaagaggccggcaugcaaccgcaauuacaaauaagaggggucggguucgauaggacguuaggcggguuagaaauggaauugagauugagggagagguuagccggcuuguuuaacgaacaaaggaaagggcaacgcgccaaagacgucagagaaaaucccagggcgauggcgaaauuauuaagggaagccaacagauugaagacgguguugucggcgaaugccgaucauauggcccaaaucgagggguuaauggacgacgucgauuuuaaagccaaggucaccagggucgaguucgaagaacucugcgccgaucucuucgaaagagucccgggcccgguccaacaagcguugcaaucggcggagaugucguuagacgaaaucgaacaagucauauuagucgggggcgcgaccagagugccgcgcguccaagaagucuuauuaaaagcggucgggaaagaagaauuaggcaaaaauauaaacgccgacgaggccgcggcgaugggcgccgucuaucaagccgccgccuugucgaaggcguucaaggucaaaccguucguggugagggacgccgucguguauccgauauuagucgaauuuacccgcgaagucgaagaagaaccgggcauccauucguuaaaacauaacaagagagucuuguuuagcagaaugggcccguauccgcagaggaaggugauaacguucaauagguauucgcacgacuuuaauuuucauauaaauuauggggauuuaggguuuuuaggcccggaggacuugagagucuucgggagucaaaacuuaacgaccgucaaauugaagggcgucggggauucguuuaaaaaauacccggauuaugaaaguaaagggauaaaagcccauuuuaauuuagacgaaucgggggucuugucguuggaucgcgucgaaagcgucuucgaaaccuuagucgaagauucggccgaggaagagagcaccuugacgaaguuggggaauacgaucaguucguuauucgggggggggacgaccccggacgcgaaagaaaacgggaccgacaccgugcaagaagaggaagaaucgccggccgaaggcucgaaagaugaaccgggcgaacaagucgaauugaaagaagaggccgaagcgccggucgaagacgggagccaaccgccgccgccggagccgaaaggggacgccacgccggaaggggagaaagcgaccgagaaggagaacggcgauaaaagcgaagcgcaaaagccgucggaaaaagccgaagccggcccggaagggguggccccggcgccggaaggggaaaaaaaacaaaaaccggcgcgcaaaagaaggauggucgaagaaauaggcgucgaauuagucgucuuagauuuaccggaucucccggaagacaaauuagcccaaagcguccaaaaguugcaagaucucaccuugagggauuuagaaaaacaagagagagagaaggccgcaaauucgcucgaggccuuuaucuucgaaacgcaagauaaauuauaucaaccggaauaucaagaggucaguaccgaagaacaaagggaagaaauaagcggcaaauugucggcggccaguacgugguuagaagacgaaggggucggggcgacgaccgucaugcucaaagaaaaauuagccgaauuacgcaaauuaugucagggcuuauucuucagagucgaagaaaggaaaaaauggccggagagauuaagcgcguuggacaacuuguugaaucacaguucgauguuuuugaaaggcgcgagauugauaccggaaauggaucaaauauuuaccgaagucgaaaugaccacccucgaaaaggugauaaacgaaacgugggcguggaaaaacgccaccuuagcggaacaagccaaauuaccggcgaccgaaaaaccgguccucuugagcaaggauaucgaggccaaaaugauggcguuagauagggaaguccaauacuuauugaacaaagcgaaauucacgaaaccgagaccgagaccgaaagauaaaaacggcacgagagccgaaccgccguugaacgcgucggcgucggaucaaggcgaaaaagugauaccgccggccgggcaaaccgaggacgccgaaccgaucagcgagccggaaaaggucgaaaccgggagugaaccgggggauaccgaaccgcucgaacucggggggccgggggccgagccggagcaaaaggagcagagcaccgggcaaaaaagaccgcucaaaaaugaugaguugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5853 - RNA, 2475 nt, Artificial Sequence
  mRNA product Design5 comprising derived and/or modified sequence from Homo sapiens__NP_005339.3 __HsHSP90AA1 (opt10)
gggagagucccgcagucggcguccagcggcucugcuuguucgugugugugucguugcaggccuuauucaagcuuaccaugccggaggagacgcaaacgcaggaucagccgauggaggaagaggagguagagacauucgcauuccaggcggagauagcacaauuaaugucguuaauaauuaacacguucuacaguaacaaggagauauucuuaagggaguuaauaucgaacucgucggacgcguuggacaaaauacgauacgaaucguuaacggacccgucgaaguuagacucggguaaggaguugcacaucaacuuaauuccgaacaagcaggaccggacguuaacgauaguagacacggguauaggaaugacgaaagcggacuugauaaacaacuuaggaacgauagcgaagucggguacuaaggcguucauggaggcauuacaggcgggugcggacauaaguaugauaggucaauucggggucggauucuacucggcauacuuagucgcagagaagguaacgguaaucacgaagcacaacgacgacgaacaauacgccugggagaguucggcgggugguaguuucacgguacgcacugacacgggugagccgauggguagggguacgaagguaauauuacacuuaaaggaggaccagacggaauacuuagaggagcgccggaucaaggagauuguuaaaaagcacucgcaauucaucggcuacccuauaacguuauucgucgagaaggagcgcgacaaggagguuagugacgacgaggcggaggagaaagaggacaaggaggaggagaaggaaaaggaggagaaggagucggaggacaagccggagauagaggacguaggaucggacgaggaggaggagaagaaggacggggacaaaaagaagaagaaaaagauaaaggagaaauacauagaccaagaggaguuaaacaagacgaagccgaucuggacaaggaacccggacgacauaacgaacgaggaguacggugaguucuacaagucguuaacaaacgacugggaggaccacuuagcggucaaacacuucaguguagaggggcaguuagaguuccgcgcguuguuauucguaccgaggcgcgcgccguucgacuuauucgagaaccggaagaagaaaaacaauauaaaguuauacguccgaaggguauucauaauggacaacugcgaggaguuaauuccggaguaccucaacuucauacgcggugucgucgacucggaagacuugccguuaaacaucucgcgagagauguuacagcagucgaagaucuuaaagguaauacgcaagaacuuagucaagaagugcuuagaguuauucacggaguuggcagaggacaaggagaauuacaaaaaauucuacgagcaguucucgaagaauauaaaguuagggauacacgaggacagucagaaccgaaaaaaguuaucagaauuauuacgauacuauacgagugcgucgggggacgaaauggucaguuugaaggacuauuguacacggaugaaggaaaaccaaaagcacauauacuacauaacgggggagacgaaggaccaaguugcgaacucggcauucgucgagcgcuuacggaagcacggguuagaggucauauacaugaucgaaccuauagacgaguauugcguacagcaauugaaggaguucgaggggaagacauuaguaaguguaacaaaggagggguuagaguugccggaggacgaggaggagaagaagaagcaggaggagaagaagacgaaguucgagaacuuaugcaagauaaugaaggacauauuagagaagaaggucgagaaggucgucgucucuaacagguugguaacgucgccgugcugcauaguaacgucgacuuacgguuggacugcgaacauggaacgaauaaugaaggcgcaggcguuaagggacaacaguacgauggguuacauggcggcaaagaagcauuuagaaaucaacccggaccacucgaucauagagacguuacgacagaaggcggaggcggacaagaacgacaagagugucaaagacuuaguaauauuauuauacgagacggcguuguuaucgaguggguucucguuagaggacccacaaacucacgcgaaccgaauauaucgcaugauaaaguugggauuaggaaucgacgaggacgacccgacggcggacgacacaucggcggccguaaccgaggagaugccgccguuagagggugacgacgauacuucgcggauggaggagguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5854 - RNA, 2451 nt, Artificial Sequence
  mRNA product Design5 comprising derived and/or modified sequence from Homo sapiens__NP_031381.2__HsHSP90AB1 (opt10)
gggagagucccgcagucggcguccagcggcucugcuuguucgugugugugucguugcaggccuuauucaagcuuaccaugccggaggagguccaucauggcgaggaagagguggagacguuugcguuucaagcggaaaucgcgcaguugaugucgcucauaaucaauacguuuuauaguaauaaggagauauuuuugcgcgaacucaucagcaaugccucggaugcguuagauaaaauccgcuaugagucguugaccgauccgagcaaguuagauagcgggaaagaacucaagaucgauauaauaccgaauccgcaggagaggaccuugacguuggucgauacggggaucgggaugaccaaggcggauuugaucaauaacuuggggaccaucgcgaaaucgggcaccaaggcguuuauggaagcguugcaggccggggcggauaucucgaugauagggcaguuuggggucggguuuuauucggccuauuugguggcggagaaagucgucgucauaaccaagcauaaugaugaugagcaguaugcgugggagucgucggcggggggcucguuuaccgugcgcgccgaucauggggagccgaucgggaggggcaccaaggucauauugcauuugaaagaggaucagacggaguaucucgaggaaaggcgcgugaaagagguggugaagaagcauucgcaauuuauaggguauccgaucacguuguauuuagagaaggaacgcgagaaagagaucucggaugaugaagcggaagaggagaagggggagaaggaggaggaggauaaggaugaugaggagaaaccgaaaauagaggaugucgggucggaugaggaggaugauagcgggaaagauaaaaagaagaagaccaagaagauaaaggaaaaguauauagaucaggaggaauuaaauaagaccaagccgauauggacgcgcaauccggacgauauaacccaggaggaguauggcgaguuuuauaagagcuugaccaaugauugggaagaucauuuggccgucaaacauuuuucggucgaggggcaguuggaguuucgcgccuuguuguuuauaccgcgccgcgccccguuugauuuauuugagaauaaaaagaagaagaauaauaucaaauuguaugugaggaggguguuuaucauggauagcugugaugaguuaauaccggaguauuugaauuuuauaagaggggucgucgauagugaggauuugccguugaauauaucgagggagauguugcagcaaucgaaaaucuuaaaggucauacgcaagaauauagucaagaaauguuuggaguuguuuucggagcucgccgaagacaaggagaauuauaaaaaguuuuaugaggcguuuucgaaaaauuugaaguuagggauccaugaggauucgacgaacaggcgcagguugucggaguuguugcgcuaucauaccucgcaaucgggggaugaaaugaccucguugagugaguaugucucgagaaugaaggagacccagaaaagcaucuauuauauaacgggggaaucgaaagagcaggucgccaauagcgccuuuguggagagggucaggaaaaggggguuugagguggucuauaugaccgaaccgauagaugaauauugcguccagcaauugaaggaguuugaugggaagucguuggugagcgucacgaaggagggguuggagcucccggaggaugaggaggaaaaaaagaagauggaggagagcaaggcgaaguuugaaaaucucuguaaauuaaugaaggaaauauuggauaagaaagucgagaaagugaccauaagcaauagauuagucucgagcccguguuguauagugaccucgaccuauggguggaccgccaauauggagaggaucaugaaggcccaggcguugcgcgauaauagcacgaugggcuauaugauggcgaaaaagcauuuggagaucaauccggaucauccgaucgucgagaccuugcgccagaaagcggaggccgauaagaaugauaaggcggucaaggauuuggucguguuauuguuugagaccgcguuguugagcucgggguucagcuuagaagauccgcagacgcauucgaaucgcauauauaggaugaucaaauugggguuagggaucgaugaagaugaggucgcggccgaggaaccgaaugccgccgugccggaugagauacccccguuagagggcgaugaagaugccagccgcauggaggaaguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5855 - RNA, 2688 nt, Artificial Sequence
  mRNA product Design5 comprising derived and/or modified sequence from Homo sapiens__NP_003290.1__HsHSP90B1 (opt10)
gggagagucccgcagucggcguccagcggcucugcuuguucgugugugugucguugcaggccuuauucaagcuuaccaugcgcgcguugugggucuuggguuuguguugugucuuguugacauuugggagcgugagggccgaugaugaaguggauguagaugggaccguggaggaagauuuggggaagucgagggaggggucgagaaccgacgaugaagugguacaaagggaagaggaagccauccaauuggacggguugaaugcgucgcaaaucagggaauugagagaaaaaucggagaaauucgcguuucaggcggaggugaaucgcaugaugaaguugauuauaaauaguuuguauaagaacaaggaaaucuuuuuaagagaguugauaaguaaugcgucggacgcgcucgacaaaaucagguugauaucguuaaccgaugagaacgcgcucucgggcaaugaagaguugacggucaagaucaaaugugauaaagaaaaaaauuuauugcacgucaccgauacaggggucgggaugacgagggaggaauuggugaagaauuuggggacgaucgcgaaaucggggaccucggaauuuuugaauaagaugaccgaagcgcaagaggaugggcaaagcaccucggaauugaucgggcaauuuggcgucggcuuuuauucggccuuuuuggucgccgauaaagucaucgugaccucgaagcauaauaaugacacgcaacauauuugggaaagcgauucgaaugaguucucggucauagccgaucccagagggaauaccuuggggcgcgggacgacgauaaccuuggucuugaaagaggaagccagcgauuauuuggaguuagauaccauaaagaauuuggucaaaaaguacucgcaauuuauuaauuuucccaucuauguguggucgagcaaaaccgagaccgucgaagaaccuauggaagaagaagaagccgcgaaggaggaaaaggaggagagcgacgaugaggccgccguggaagaggaggaagaggaaaagaaaccgaaaacgaaaaaggucgaaaagacggucugggauugggaguugaugaacgauauuaagccgaucuggcaaaggcccucgaaggagguggaagaggaugaauauaaggcguuuuauaaaucguuuucgaaagagucggacgauccuauggcguacauccauuucaccgcggagggggaagucaccuuuaagucgauauuguuugugccuaccucggcgccgcgcggguuguucgaugaguauggcucgaaaaaaucggauuauauaaaguuguauguaaggagagucuuuauuacggaugauuuucaugauaugaugccgaaauauuuaaauuucgugaaaggggucgucgacagcgacgauuuaccguugaacgucucgcgcgaaaccuugcaacaacauaaguuauugaaagucaucaggaaaaaauuggugcgcaagaccuuggauaugauaaaaaaaaucgccgacgacaaauauaacgauaccuuuuggaaggaauuugggacaaauauuaaguugggggucauagaggaucauucgaacaggacccgcuuggccaaguuguugcgcuuucaaucgucgcaccauccgaccgauaucaccucguuagaucaauacgucgagaggaugaaagagaagcaagauaagauauauuuuauggccgggaguucgaggaaggaagccgagucgucgccguucgucgaaagguuguugaaaaaaggguacgaggugauauaucucacggagccggucgaugaguauuguauacaagcguugccggaauuugaugggaaacgcuuucaaaacguggccaaagagggggucaaauuugaugagucggaaaaaaccaaagaaagccgcgaggccguggaaaaggaauuugaaccguuauugaauuggaugaaggauaaggcauugaaagauaaaaucgagaaagccgucgucagccaaagauuaacggaaucgccgugcgcguugguggcaucgcaauauggguggucggguaauauggaacgcauaaugaaagcccaagcguaucaaaccgggaaagauauaucgacgaauuauuaugcgucgcaaaaaaaaaccuuugagauaaauccgcgccaucccuugauucgcgauauguugaggcgcauaaaagaggaugaagacgauaaaacggucuuggauuuggcaguagucuuguuugagaccgcgaccuugcgcucgggguauuuauugccggauaccaaggcguauggggauaggauagagaggauguugcgcuugucguugaauaucgauccggacgccaaagucgaggaagaaccggaagaagaaccggaggaaaccgccgaagauacgacggaagauaccgaacaagaugaagacgaagaaauggacguagggaccgaugaggaagaggagacggccaaagagagcacggccgagaaagaugaguugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5856 - RNA, 2391 nt, Artificial Sequence
  mRNA product Design5 comprising derived and/or modified sequence from Homo sapiens__NP_057376.2__HsTRAP1 (opt10)
gggagagucccgcagucggcguccagcggcucugcuuguucgugugugugucguugcaggccuuauucaagcuuaccauggcgagggagcucagggcguuguuguugugggggaggagguugaggccguuguugagggcgccggccuuggcggccgugccgggggggaagccgaucuuguguccgaggcgcaccaccgcccaguuggggccgaggaggaauccggcguggagcuugcaagcggggagguuguuuaguacccagacggcggaggauaaggaggagccguugcauucgaucauaucgucgacggaaaguguccaggggucgacgaguaagcaugaauuucaagcggagacgaaaaaguuguuggauauagucgcgaggucguuguauagugagaaggagguguuuauaagggaguugauaagcaaugccagugaugccuuggagaaguugaggcauaaguuggucagcgaugggcaggccuugccggagauggagauccacuugcagacgaaugccgagaaggggacgaucaccauccaggauaccgggaucgggaugacccaagaagaguuggugagcaauuuggggaccaucgcgaggucggggucgaaggcguuuuuggaugcguugcagaaucaggcggaggcgaguaguaagauaauagggcaauuuggggucggguuuuacagugcguuuauggucgccgauaggguggaggucuacagcaggagcgccgcgccggggaguuugggguaucagugguugagugaugggucgggggucuuugagaucgccgaggcgagcggggugaggaccgggacgaagauaauaauccauuugaagucggauuguaaggaguucucgagcgaggcgagggugagggauguggugacgaaguacagcaacuuugugagcuucccguuguacuugaaugggcgcaggaugaauaccuugcaggcgauauggaugauggauccgaaggaugugagggaguggcaacacgaggaauuuuauagguaugucgcccaggcccaugauaagccgagguauacguugcauuauaagaccgaugcgccguugaauauaaggaguauauuuuauguccccgauaugaagccgucgauguuugaugucaguagggaguuggggagcagcgucgccuuguauagccgcaagguguugauccagaccaaggcgacggauauauugccgaagugguugagguuuauacgcggggugguggauucggaggauauaccguugaauuugagcagggaguuguugcaggagagugcgcucauaaggaaguugagggaugucuugcagcaaagguugaucaaguuuuuuauagaccagaguaaaaaggacgccgagaaguaugcgaaguuuuuugaggauuauggguuguuuaugagagaggggauagucaccgccacggaacaggaagugaaggaagauaucgccaaguuguugcgcuaugaaaguucggcguugccgagcgggcaguugaccucguugucggaguaugcgagcaggaugcgcgccgggacgaggaauauauauuauuugugugcgccgaauaggcauuuggccgagcauagcccguauuaugaagcgaugaagaaaaaggauacggagguguuauuuuguuucgagcaguuugaugaguuaacguuguugcauuugcgcgaauuugauaagaaaaaguugauaucgguggaaaccgauauaguggucgaucauuauaaggaggagaaguuugaagauaggucgccggcggccgaguguuugagcgagaaggagacggaggaguugauggcguggaugagaaauguguuggggagucgcgucacgaaugucaaggugaccuugcgcuuggauacgcauccggcgauggugacggucuuggagaugggggccgcgaggcauuuuuugaggaugcagcaguuggccaagacccaagaagagagggcgcaguuguugcagccgacguuggagaucaauccgaggcaugcguugaucaaaaaguugaaccaguuacgcgcgagugaaccgggguuggcgcaguuguugguggaucaaauauaugagaaugcgaugauagccgccggguuggucgaugauccgagggcgauggucgggagguugaacgaguuguuggugaaggccuuggaaaggcacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5857 - RNA, 738 nt, Artificial Sequence
  mRNA product Design5 comprising derived and/or modified sequence from Homo sapiens__NP_000609.1__HsIGF1 (opt10)
gggagagucccgcagucggcguccagcggcucugcuuguucgugugugugucguugcaggccuuauucaagcuuaccauggguaagaucucgucauuaccgacgcaguuguucaagugcugcuucugcgacuucuuaaagguaaagaugcacacgaugucgaguucccacuuauucuacuuggccuuaugcuuguugacguucaccuccucggcgaccgcagggccggagaccuugugcggcgcggaguuaguagacgcguuacaguucgucugcggugaccgagguuucuacuucaacaagccgacggguuacggguccucgucgcgccgugcaccgcagacgggcaucguugacgaaugcugcuuccguucuugcgaccuccgucgcuuagagauguacugcgcgccguugaagccggcgaagucggcccguucgguacgcgcgcagcggcacacggacaugccaaagacgcagaaagagguccacuuaaagaacgcgucgcguggaucggccggcaacaagaacuaccggaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5858 - RNA, 819 nt, Artificial Sequence
  mRNA product Design5 comprising derived and/or modified sequence from Homo sapiens__NP_000603.1__HsIGF2 (opt10)
gggagagucccgcagucggcguccagcggcucugcuuguucgugugugugucguugcaggccuuauucaagcuuaccaugggcauacccauggguaagucaauguugguguuauuaaccuucuuagccuucgccucgugcugcaucgcggccuaccguccgucagagacccuaugcggcggggagcuaguagacacgcuacaguucgugugcggcgaccggggguucuacuucucgcgccccgcgucgcgcgugucccgccguucgcgcggcaucguagaggagugcugcuuccgaucaugcgacuuggccuuauuagagaccuacugcgccaccccggccaagucggagcgagacgugucgacgccgccgaccguguuaccggacaacuucccccgguaccccgucggcaaguucuuccaguacgacacguggaagcagucgacucagagacuucgucgcggguuaccggcguuguugcgugcccgacgaggccacgugcuagccaaggaguuagaggcguuccgcgaggcgaagcggcaccgcccguuaaucgcguuacccacucaggaccccgcgcacggaggcgccccgcccgagauggcgucgaaccgaaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5859 - RNA, 915 nt, Artificial Sequence
  mRNA product Design5 comprising derived and/or modified sequence from Homo sapiens__NP_000591.1__HsIL6 (opt10)
gggagagucccgcagucggcguccagcggcucugcuuguucgugugugugucguugcaggccuuauucaagcuuaccaugaacucguucaguacgucggcguucggccccgucgcguucucguuagguuuguuauuggucuuaccggcggcguucccagcgcccguuccaccgggugaggacucgaaggacguugcggcgccccaccgacagcccuugaccucguccgagcguaucgacaagcagauccgauacaucuuagacgguauaagugcguuacgcaaggagacgugcaacaaaucgaacaugugcgagaguucgaaggaggcguuagccgagaacaaccucaacuugccgaagauggcggagaaggacgggugcuuccagaguggguucaacgaggagacaugcuuaguaaagaucauaacgggccuccuugaguucgaggucuaccucgaguacuuacagaacagguucgagucaucggaggagcaggcacgcgcgguucaaaugucgacgaagguauugauccaguuccuccagaagaaggccaagaacuuagacgcgaucacgacgccggacccgacuaccaacgcgaguuuguuaacuaaguuacaggcgcagaaccagugguugcaggacaugaccacccacuugaucuugcggucguucaaggaguucuugcagaguucuuuaagagcguuaaggcagaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5860 - RNA, 1557 nt, Artificial Sequence
  mRNA product Design5 comprising derived and/or modified sequence from Homo sapiens__NP_002183.1__HsINHBA (opt10)
gggagagucccgcagucggcguccagcggcucugcuuguucgugugugugucguugcaggccuuauucaagcuuaccaugccguuauugugguuaaggggguucuuguuagcgucgugcuggaucaucgugcguucgucgccgacgcccgggucggagggucacucggccgcaccggacugcccaaguugcgcacuugccgcguuaccgaaggacguuccgaacucgcagccggagaugguugaggccgugaaaaagcacauauugaacauguuacaccuaaagaagcgaccggacguaacgcagccgguccccaaagcggcccuauuaaacgcuauacggaaguuacacguugggaagguaggcgagaacgguuacguggagaucgaggacgacaucgggcgccgcgccgagaugaacgaguuaauggagcagacgucagagaucaucaccuucgcggagucgggcacugcgcguaagacuuugcacuucgagaucucgaaggaggguucggacuuaucggugguagagcgggccgaggugugguuauucuugaaggugccgaaggcgaaccgaacgcgaaccaaggucaccauccgauuguuccagcaacagaaacacccccaggggaguuuagacaccggggaggaggccgaggagguaggucucaagggggagcgauccgagcuccucuuaucggagaagguggucgacgcgcgaaagucuacguggcacguauucccggugucgucgucgauccagcgccuacuugaccagggcaagaguucguuggacguccgcauagcgugcgagcagugccaggagucgggcgcgucucuuguauuguuagggaagaagaagaagaaggaggaggagggugaggggaagaagaaggggggcggggagggcggggcgggcgcggacgaggagaaggagcagucucaccggccguucuuaauguuacaagcgcgucaaucggaggaccacccgcaccgacgacgccgacguggguuagagugcgacggcaaggugaacaucugcugcaagaagcaguucuucguuucauucaaggacaucgguuggaacgacuggauaauagccccgucgggguaccacgcgaacuacugcgagggcgagugcccgucccacaucgccgguacuucgggcucgucguuaucguuccacaguacgguuauaaaccauuaccguaugcguggacacucccccuucgcgaacuugaagaguugcugcgugccgaccaaguugcgucccaugucgaugcuuuacuacgacgacggccagaacauuauaaagaaggacauccagaacaugaucgucgaggaaugcggcugcaguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5861 - RNA, 1500 nt, Artificial Sequence
  mRNA product Design5 comprising derived and/or modified sequence from Homo sapiens__NP_002184.2__HsINHBB (opt10)
gggagagucccgcagucggcguccagcggcucugcuuguucgugugugugucguugcaggccuuauucaagcuuaccauggacgguuuaccgggacgagcuuugggugcggcuuguuuguuauuguuggcagcggguugguuaggcccggaagcguggggaucgccgacaccucccccuacuccggcggcgccaccgcccccgccaccgccggggucgccaggcgggucccaagauacuugcacaaguugcggggguuuccgacgacccgaggaauugggacgcguagacggugauuucuuggaagcuguaaagcgucauaucuuaucgcguuuacagaugcgagggcgaccgaacauaacccacgccguaccgaaggcggcgaugguuaccgcguuacgaaaguuacaugcugggaagguucgugaggacgggcguguagagaucccccauuuggacgggcacgccucgccaggggccgacgggcaagagcgagucucggagauaauuaguuucgcggagacugacggguuagcgucgucgaggguacguuuauacuucuucauaucgaacgaggguaaccaaaacuuguucguaguacaggcgaguuuaugguuauaccuuaagcuauuaccauacguuuuagagaaggggucgcgucgaaaaguaaggguaaagguauacuuccaagagcaaggucacggcgaccgauggaacaugguagagaagcggguugaccuuaagcgaaguggauggcacacguucccguuaacugaggcaauacaggcauuauucgagcguggagagcgccgcuuaaacuuagacguacaaugcgacucgugccaggaguuggcagucgucccaguauucguagaccccggggaggagagucaucgaccguucguaguaguacaggcgcgcuuaggugacucgcgacaccgaauccggaagcgugguuuagagugcgacgguaggacgaacuugugcugccgacagcaguuuuuuauagacuuuagguugaucggguggaacgacuggauaauugcgccgacaggauacuacgguaacuauugcgaaggaaguugcccggcguacuuagcgggggugccagguucggcaucgucguuccacacugcgguaguuaaccaguaccgaaugcgaggauugaauccggggacaguaaacucgugcugcaucccgacgaaguuaaguacgaugucgauguuauacuucgacgacgaguacaacauaguaaagcgcgacgucccgaacaugaucguagaagagugcgguugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5862 - RNA, 3735 nt, Artificial Sequence
  mRNA product Design5 comprising derived and/or modified sequence from Homo sapiens__NP_000623.2__HsITGAM (opt10)
gggagagucccgcagucggcguccagcggcucugcuuguucgugugugugucguugcaggccuuauucaagcuuaccauggcguugaggguccucuuauugaccgccuugaccuuaugccauggguuuaauuuggauacggagaacgccaugacguuucaggagaaugccaggggguuugggcagagcgucgugcaguugcaggggagcagggucguggugggggcgccgcaggaaaucguggccgccaaucagagggggagcuuguaucagugugauuauagcacgggcagcugugagccgauacgcuuacaggugccgguggaggccgugaauaugucguuaggguugucguuggcggcgaccacgagcccgccgcaguugcucgccugugggccgacggugcaccaaacguguagcgagaauacguaugucaagggguuguguuucuuguucggcaguaauuugaggcaacaaccgcagaaguuuccggaggcguugagggggugcccccaggaggauucggauaucgcguucuugaucgaugggagugggaguaucaucccgcaugauuuuaggagaaugaaagaguucgugagcaccgucauggagcaguugaaaaagaguaagaccuuguuuaguuuaaugcaguauucggaagaauuucgcauacauuuuacguuuaaggaauuucaaaauaauccgaauccgaggagcuuagucaagccgaucacccaguuguuggggcgcacccauaccgcgaccgggauacgcaaaguggucagggaguuguuuaauaucaccaacggggccaggaagaaugcguuuaagauauuggucgugaucacggauggggagaaguuuggcgauccgcucggguaugaggaugucauaccggaggccgaucgcgaaggggucauaagguaugugauaggggucggcgaugcguuuaggucggagaagaguaggcaagaguugaauaccaucgcgaguaagcccccgagggaucauguguuucaggugaauaauuuugaggcguugaagacgauacagaaucaguugagggaaaagaucuuugcgaucgaggggacgcagacggggucgaguucgaguuuugagcacgagaugagucaggagggguuuucggcggccauaacgaguaaugggccguuguugagcacgguggggagcuaugauugggccggggggguguuuuuguauacgaguaaagagaagaguaccuuuauaaauaugacgcgcguggacagcgauaugaaugaugccuacuugggguaugcggccgccauaaucuugaggaaucgcguccagagcuugguccucggggcgccgagguaucagcauauaggguuggucgccauguuuaggcagaauacgggcaugugggagucgaaugccaaugugaaagggacgcagauaggggccuauuuuggggccagcuuguguagcgucgauguggauagcaaugggucgaccgacuuggucuugauaggggccccgcauuauuacgaacaaaccaggggggggcaggucagcgugugcccguugccgagggggagggcgagguggcagugugaugccgucuuguacggggagcaggggcagccgugggggcgcuuuggggcggccuugacgguguugggggaugugaauggggauaaguugacggaugucgccauaggggccccgggggaagaggauaauaggggggccgucuauuuguuucaugggacgagugggucggggauaagcccgagucauagccagaggaucgcggggagcaaguuaaguccgcgcuuacaguauuuuggccagucguugaguggggggcaggauuugaccauggauggguuggucgacuuaaccgucggggcccagggccacgucuuguuguugaggagucagccggucuugagggugaaagccauaauggaauuuaacccgagagagguggccaggaauguguuugaguguaaugaucaggucgugaaagggaaggaggcgggggaggugcgcgucugcuuacauguccagaaaucgaccagggacagguuaagggaggggcagauacaaagugucgugacguaugauuuggcguuggauagugggcgcccgcauucgagggcgguguuuaaugagacgaagaacagcacgaggagacagacgcaagucuugggguugacgcagaccugugaaaccuugaaguugcaguuaccgaauugcauagaggauccggugagcccgauagucuugagguugaacuucaguuugguggggaccccguugagcgccuuugggaauuugaggccgguguuggcggaggaugcgcagagguuguuuacggcguuguuuccguuugagaaaaauugugggaaugauaauaucugccaggaugauuugucgauaacguuuagcuuuaugagcuuggauuguuuggucgucggggggccgagggaguucaaugugaccgugacgguccgcaaugauggggaagacaguuaucgcacccaggucaccuuuuuuuuucccuuggauuugagcuauaggaaggugagcacguugcagaaucagaggagccagaggagcuggcgcuuggccugcgagagcgcgagcagcaccgaggucucgggggcguuaaagagcacgaguugcaguaucaaucauccgauauuuccggaaaauucggaggugaccuuuaauaucaccuuugaugucgauagcaaggccagcuuggggaauaaguugcucuuaaaggcgaaugugacgucggagaauaauaugccgcgcaccaauaagaccgaauuucaguuggaguugccggugaaauacgcggucuauaugguggugacgucgcauggggucaguaccaaguauuugaauuucacggcgucggagaauaccagucgcgucaugcagcaucaguaucaagucaguaauuuggggcagaggucguugccgauaaguuuggucuuuuuggucccggugcgcuugaaucaaaccgucaucugggauaggccgcaggucaccuuuagcgagaauuugaguaguaccugccauaccaaggagagguugccgucgcacagugauuucuuggccgaauugaggaaggcgccggucgucaauuguagcauagccgucugucaaaggauccaaugugauaucccguuuuucggcauccaagaggaauuuaaugccaccuugaaggggaauuugucguuugauugguacauaaaaacgagccacaaucauuuguugaucgucaguaccgcggagauauuguuuaaugauucgguguuuacccucuuaccggggcagggggccuuugucaggagccaaaccgagaccaaggucgagccguuugaggugcccaaucccuugcccuugauaguggggaguagugucgggggcuuguuguuguuggcguugauaaccgccgccuuauacaaauugggguuuuuuaaaaggcaguauaaggacaugaugagugagggggggcccccgggcgcggagccgcaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5863 - RNA, 1680 nt, Artificial Sequence
  mRNA product Design5 comprising derived and/or modified sequence from Homo sapiens__NP_002415.1__HsMMP8 (opt10)
gggagagucccgcagucggcguccagcggcucugcuuguucgugugugugucguugcaggccuuauucaagcuuaccauguuuaguuuaaaaaccuugccguucuuauugcucuugcacguccaaaucaguaaagcguucccggucagcagcaaggaaaagaacaccaagaccguccaagauuauuuagagaaauuuuaucagcucccgucgaaucaauaccaaagcacccgcaaaaacgggaccaacgucauagucgagaaauugaaggagaugcaaagguucuucggccucaacgucaccggcaaaccgaacgaagagaccuuagauaugaugaagaaaccgaggugcggggucccggauucggggggguucaugcucacgccggggaauccgaaaugggagaggaccaaucucacguaucgcaucaggaauuacacgccgcaauuaagcgaagccgaagucgagcgcgccauaaaagacgcguucgaguuguggucggucgccagcccguugauauuuacgcgcauaagccaaggggaagccgacauaaauaucgccuucuaucagcgcgaccauggggauaacagcccguucgacgggccgaacgggauauuggcccacgcguuccaaccggggcaggggaucgggggggacgcccacuucgacgcggaggagaccuggacgaauacgagugccaacuauaaucucuucuuggucgccgcccacgaguucgggcacagccucggcuuggcccauaguagcgauccgggggcgcucauguacccgaauuacgccuuucgcgagacgucgaauuauagcuugccgcaggacgauauagacgggauccaagcgauauacggguugagcucgaauccgauacagccgaccgggccgucgaccccgaagccgugcgauccgucgcucaccuucgacgccauaacgaccuugaggggggagaucuuguuuuucaaggaucgcuauuuuuggcgccgccacccgcaauugcagcgcguggagaugaacuucaucagcuuguuuuggccgaguuugccgaccgggauccaagccgccuacgaggacuucgaucgcgauuugaucuuuuuguucaaggggaaucaguauugggccuuaucgggguacgacaucuuacagggguacccgaaagacaucagcaauuacggguuuccgucgucggugcaggccaucgaugccgccgucuuuuaucgcucgaagaccuauuuuuucgucaacgaucaguuuuggcgcuacgacaaucagcgccaguuuauggaaccgggguacccgaagucgaucagcggggcguucccggggaucgaaucgaaggucgacgccgucuuucaacaggagcacuuuuuucacguguuuucggggccgcgcuacuaugccuucgacuugaucgcccaacgcgucacgcgcgucgcccgcgggaacaagugguugaauugccgcuacgggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5864 - RNA, 2400 nt, Artificial Sequence
  mRNA product Design5 comprising derived and/or modified sequence from Homo sapiens__NP_004985.2__HsMMP9 (opt10)
gggagagucccgcagucggcguccagcggcucugcuuguucgugugugugucguugcaggccuuauucaagcuuaccaugucguuauggcaaccuuugguauugguauuauuggucuuagggugcugcuucgcagcgccgcgucagcgacagucgacauuagucuuguucccgggugacuuacgaaccaacuuaacugaucggcaauuagcugaagaguauuuauacagguacggcuacacgcgcguagcggagaugaggggggagucuaagaguuuaggcccagcauuacucuuguugcagaaacaguuaucguuacccgaaacgggggaauuagacucggcgacacucaaggcgaugcgcacuccucguugcggaguacccgacuugggacgauuucagacauucgagggugauuugaaguggcaccaccacaacauaacguacuggauccagaacuacucugaggacuuaccucgugcaguaauagacgacgcuuucgcacgagcguucgcuuuauggucggccguuacacccuugacguuuacgcgagucuauucgcgcgacgccgacauaguaauacaguucgggguagccgagcacggugacggcuacccauucgacgguaaggacgguuuauuagcgcacgcguucccgccggggccggguauccagggcgacgcgcacuucgacgacgacgaauuauggucuuuagggaaagggguaguuguaccuacgcguuucgguaacgcggacggugccgcaugccauuucccguucauauucgaggggcgaucauauagugcgugcacuacggacggacggucggacggguuacccugguguucgacuacugcgaacuacgacacggacgaccgauucgguuucugcccgucggagcguuuauacacgcaagacgguaacgcggacggcaagccuugccaguucccuuucauauuccagggacagucguacucggcaugcacaaccgacgggcggucggacggguaccgguggugcgcgacuacggcgaacuacgaucgcgacaaguuauucggguucugcccaacacgggcagacucuaccguaaugggagggaacagugccggagaguugugcguauuccccuucacguucuugggaaaagaguacucaacaugcacuucggaaggccggggugacggucgauuguggugcgccacuacgaguaacuucgacucggacaaaaagugggguuucuguccugaccagggcuauucguuauucuuaguagcagcacacgaguucgggcacgcauuaggauuggaccacaguaguguacccgaagcauugauguauccgauguaccgauuuacggaagguccgccguuacacaaggacgacguaaacgguauccgacacuuauacggcccacggccggagccggaaccgcgcccaccgaccacaacgacuccacagcccacugcaccgcccacaguauguccuacggguccuccgacaguacacccgucggagcgaccgacggcaggucccacuggaccgccgagugcagggccgacggggccgccgaccgcagguccgucgacggcgacaacggucccguuaucgcccguagacgacgcgugcaacguuaacauauucgacgcaauagcagagauagguaaccaguuauacuuauucaaggacggcaaguacuggcgcuuuucggaggggcgaggaagucgaccccaggggccguucuuaaucgcggacaaguggccggcauuaccucgaaaguuagauucaguauucgaggagcgauuaaguaagaaauuauucuucuucucggguaggcaaguauggguauauacgggugccuccguauuagggccccggaggcucgacaaguuggggcucggugcugacgucgcgcagguaacgggugcuuuacgcucgggucgaggaaagauguuauuauucaguggucgccgauuauggcguuucgacguaaaggcacagauggucgacccucgaucggcgucggaggucgaccguauguucccggguguaccguuagacacacacgacguauuccaguaccgcgaaaaggcuuacuucugccaggauagguucuacuggcgagucucgucgaggucggaauuaaaucaaguagaccagguaggguaugucacguacgacaucuuacagugcccggaggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5865 - RNA, 1692 nt, Artificial Sequence
  mRNA product Design5 comprising derived and/or modified sequence from Homo sapiens__NP_002418.1__HsMMP13 (opt10)
gggagagucccgcagucggcguccagcggcucugcuuguucgugugugugucguugcaggccuuauucaagcuuaccaugcacccgggcguguuagccgcguuuuuguuucucucguggacccacugcagagcguuaccguugccgucggggggggacgaggacgaccucagcgaagaggauuugcaauucgccgaaagguauuuacgcagcuauuaucacccgaccaacuuggccgggauauuaaaagaaaacgccgccucgaguaugaccgaacgcuugagggagaugcaaaguuuuuuugggcucgaagucaccgggaaguuggaugacaauacgcucgacgugaugaagaaaccgcgcuguggcgucccggacgucggggaguauaacgucuuuccgaggaccuugaaguggaguaagaugaaccucacguaucgcaucgucaacuauacgccggacaugacccacagcgagguggagaaagccuuuaagaaggcguuuaaggucuggagugacgucaccccguuaaacuucacgcgcuugcaugacgggaucgccgauauaaugauuagcuucgggaucaaagaacacggggauuuuuauccguucgacggcccgagcggguuauuagcccacgccuucccgccgggcccgaacuacgggggggacgcgcacuucgacgacgacgagacguggaccucgucgaguaagggguauaaucucuucuuggucgccgcccacgaauuugggcauagucucggguuggaucauaguaaagauccgggggccuugauguucccgauauauacguauacggggaagucgcauuucauguugccggacgaugacguccagggcauacaaaguuuguacgggccgggggacgaggauccgaauccgaagcacccgaagaccccggauaagugcgauccgagucucaguuuggacgcgaucacgucguugaggggggagaccaugauauucaaggaucgcuuuuuuuggagguuacacccgcaacaagucgacgccgaauuauuccucaccaagagcuucuggccggaguugccgaauaggaucgacgccgccuacgaacauccgagccacgauuugauauuuauauuucgcgggcgcaaguucugggccuugaacggguacgauaucuuagagggguacccgaagaagaucagcgaguuaggguugccgaaggaggucaaaaaaaucucggccgccguccauuucgaagacaccgggaaaaccuuguuauuuagcgggaaucaaguguggcgcuacgacgacaccaaucacaucauggacaaggauuacccccgcuugaucgaggaggauuuuccggggaucggggacaaggucgacgccguguacgaaaagaacggguacauauacuucuuuaaugggccgauccaauucgaguauucgauauggucgaauaggaucgucagggugaugccggccaacaguauccucuggugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5866 - RNA, 1344 nt, Artificial Sequence
  mRNA product Design5 comprising derived and/or modified sequence from Homo sapiens__NP_001286.1__HsCCR1 (opt10)
gggagagucccgcagucggcguccagcggcucugcuuguucgugugugugucguugcaggccuuauucaagcuuaccauggaaaccccgaacaccaccgaagauuacgacaccacaaccgaguucgacuacggcgacgccacccccugccaaaaagucaacgaacgcgccuucggcgcccaacuccucccaccccuuuacucccucgucuucgucaucggccucgucggcaauauccucguaguccucguccucguccaauacaaacgacucaaaaacaugaccuccaucuacuuacucaacuuagccaucuccgaccuccucuuccucuucacccuccccuucuggauagacuacaaacucaaagacgacugggucuucggcgacgccaugugcaaaauccucucgggcuucuacuacacaggacucuacuccgaaaucuucuucaucauccucuuaacuaucgaccgcuaccuagccaucguccacgccgucuucgcacuacgcgcccgcaccguaaccuucggcgucaucaccucaaucaucaucugggcccucgccauccucgccuccaugcccggccucuacuucucaaaaacccaaugggaguucacacaccacacaugcucacuccacuucccccacgaauccuuacgcgaauggaaacucuuccaagcccucaaacucaaccuauucggccuaguccucccacuacucgucaugaucaucugcuacacaggcaucaucaaaauacuccuccgccgccccaacgaaaagaaauccaaagcaguccgccucaucuuugucauaaugauaaucuucuuccuauucuggacccccuacaaccucaccauccucaucucaguauuccaagacuuccucuucacccaugaaugcgaacaaucacgccacuuagaccucgccguccaagucaccgaggucauugccuacacccacugcugcgucaacccaguaaucuacgccuucgucggcgaacgcuuccgcaaauaccuccgucaacuauuccaccgacgcgucgccguacaccucgucaaauggcuccccuuccuaucugucgaccgauuagaacgcgucuccuccacaagcccaagcaccggcgaacacgaacucuccgccggcuucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5867 - RNA, 912 nt, Artificial Sequence
  mRNA product Design5 comprising derived and/or modified sequence from Homo sapiens__NP_002598.4__HsPDGFA (opt10)
gggagagucccgcagucggcguccagcggcucugcuuguucgugugugugucguugcaggccuuauucaagcuuaccaugcgaacauuagcaugcuuguuguuauuagguugcggguacuuagcgcacguguuagcagaggaggcagagaucccgcgugagguuaucgagcgcuuggcacgaucgcagauccacaguauccgagacuuacagcgguuguuggagaucgacucagucggcucggaggacucguuagacacgaguuuacgagcgcacggggugcacgccacgaagcacguaccggagaagcgcccguugccgauacgucgcaagcgaucgaucgaggaggcggugcccgcgguuugcaagacgcgaaccgucaucuacgagaucccacgaucgcagguagacccuaccucggcuaacuucuuaauauggccuccaugcguagaggucaagcguugcacggggugcugcaacacaucgucgguuaagugccagccgucgcgagugcaccaccguucgguaaagguggccaagguugaguacguacgaaagaagcccaagcuaaaggagguucagguucgauuggaggagcacuuagagugcgcuugcgccacgacgaguuugaaccccgacuaccgugaggaggacacggggcgaccgcgcgagucgggcaagaagcgaaagcgaaagcgguugaagccgacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5868 - RNA, 1002 nt, Artificial Sequence
  mRNA product Design5 comprising derived and/or modified sequence from Homo sapiens__NP_002599.1__HsPDGFB (opt10)
gggagagucccgcagucggcguccagcggcucugcuuguucgugugugugucguugcaggccuuauucaagcuuaccaugaaccguugcugggcccuuuucuugucguuaugcugcuacuugcgcuuggugucggccgagggugauccgauaccggaggagcuguacgagaugcuaucugaccacaguauaaggucauucgacgacuugcagcgauuauuacacggggacccgggugaagaggacggggcggaguuagacuuaaacaugacgcgcucgcacucggguggggaguuggagucguuagcgcgggggcggcgaucguuagggucguugacgaucgcggagccugcgaugaucgcggagugcaagacgcguacggaggucuucgagauaucgcgacguuuaaucgaccgaaccaacgcaaacuucuuaguauggcccccuugcgucgagguacagaggugcaguggaugcugcaacaaccgaaacguccagugcaggccgacgcagguucaguugcguccgguacaaguccguaagaucgagaucguccguaagaagccgauauucaagaaggcuacgguaaccuuagaggaccaucucgccugcaagugcgagacugucgccgcggcgaggccgguaacucggucgcccggugggagucaggagcagcgugcgaagacgccgcagacgcgaguuaccauaaggaccguacgugugcgucguccgccgaaaggaaagcaccgaaaguucaagcacacgcacgacaagacugccuuaaaggagacguuaggugccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5869 - RNA, 1314 nt, Artificial Sequence
  mRNA product Design5 comprising derived and/or modified sequence from Homo sapiens__NP_057289.1__HsPDGFC (opt10)
gggagagucccgcagucggcguccagcggcucugcuuguucgugugugugucguugcaggccuuauucaagcuuaccaugucguuauucggcuuguuauuauugacgagugcguuagcagggcagcggcaagguacacaggcagagucgaaccucucgucgaaguuccaguucucgucgaacaaggagcagaacggugugcaggacccacagcacgagcguaucaucacgguuucgacaaacgggucgauacacucgccgcguuucccacacacguacccgcgaaacacuguguuagucuggcgucucguugccgucgaggagaacguuuggauccaguuaacuuucgacgagagguucgguuuagaggacccggaggacgacaucugcaaguacgacuucguugagguagaggagccuucagacgguacgaucuugggacgauggugcgggucggggaccguucccgggaagcagauaucgaaggggaaccagauacgaauccgauucgucucggacgaguacuucccgucggagccggguuucugcauacacuacaacauaguaaugccgcaguucacggaggccguuucgccgucugucuuaccgcccucggcguuaccguuagacuuacucaacaacgcgaucacggcguucucuacguuagaggacuuaauacguuacuuagagccggagcgauggcaauuagacuuggaggacuuguaccgccccaccuggcaguuacucgguaaggcauucguauucgggcgaaagagucgaguaguagacuuaaauuuauuaaccgaggagguucgacuauacucuugcacuccccgcaacuucucgguuucgauccgagaggagcuuaagcgcacggacacgauauucuggccggggugcuuauuggucaagaggugcggggguaacugcgcgugcugccuucacaacugcaacgagugccagugcgugccgucgaaggucacaaagaaguaccacgaggucuuacaacuucgccccaagacgggcgugcgagguuuacacaagagucuaacugacguagcgcucgagcaccacgaggagugcgacugcgucugcagggggucgaccggggggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5870 - RNA, 1371 nt, Artificial Sequence
  mRNA product Design5 comprising derived and/or modified sequence from Homo sapiens__NP_149126.1__HsPDGFD (opt10)
gggagagucccgcagucggcguccagcggcucugcuuguucgugugugugucguugcaggccuuauucaagcuuaccaugcaccgacuaaucuucguauacaccuugauaugcgccaacuucugcuccugccgagacacgucggccacuccccagucggcuaguauaaaggcccuucguaacgcgaacuugcgucgggacgaccuuuacaggagggacgagacuauccaggucaagggcaacggauacguccaaucgccccgguuccccaacaguuacccgcggaacuuacuuuugaccuggcguuuacacucgcaggagaacacgaggauccaauuaguuuucgacaaccaguucggccucgaggaggccgagaacgacauaugccgauacgacuucguagagguagaggacaucagugagaccucgacgauaaucagggggcgguggugcggccacaaggagguacccccucgaaucaagagucgaaccaaccagaucaagauaaccuucaagucggacgacuacuucguagcaaagccgggguucaagauauacuacucgcucuuagaggacuuccagccggcggccgcgucggagacaaacugggagucgguaacgucgucgauaucgggugugucguacaacucacccucggucaccgacccgaccuugauagccgacgcguuagacaagaagaucgccgaguucgacacgguagaggacuuguugaaguacuucaacccggagucguggcaggaggacuuagagaacauguacuuagacacgccgagguacagggggcggucguaccacgaccgcaagucgaagguggacuuagaccgacuuaacgacgacgcgaagcgauacucgugcacaccucgaaacuacaguguaaacaucagggaggaguuaaaguuagccaacgucguauucuucccgcggugcuuauuaguucagcguugcgggggcaacugcgguugcgggacggugaacuggcgaucuugcacgugcaacucggguaagaccguaaagaaguaccacgagguccuucaguucgagcccgggcacauaaagcgucgcggccgugcgaagaccauggcgcucguggacauucaacucgaccaccacgagcguugcgacugcaucugcucgucgcgaccuccgcguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5871 - RNA, 954 nt, Artificial Sequence
  mRNA product Design5 comprising derived and/or modified sequence from Homo sapiens__NP_003946.3__HsSOCS3 (opt10)
gggagagucccgcagucggcguccagcggcucugcuuguucgugugugugucguugcaggccuuauucaagcuuaccaugguaacgcacucgaaguucccggcggcggguaugaguaggccguuagacacaucgcuucguuuaaagacauucucgucgaagagugaauaccagcucguugucaacgcgguccggaaguugcaagaaucagguuucuauuggucggcgguaacggggggggaggcaaauuuauuauugucggcggagccagcggggacauucuuaauccgugacucgucugaccagcggcacuuuuuuacauuaucagugaagacacaaucggguacgaagaaccuucgaauacagugcgagggcggaaguuucucguugcagagugacccgcgaucuacacagccggucccucgauucgacugcguauuaaaguugguucaccauuacaugcccccaccgggggcuccgaguuucccgucaccgccgacggagccgaguucggagguaccggagcagccaucggcgcagccuuuaccggguucgccgccucgacgcgcguacuacauauacucggggggugaaaagauuccacucguauuaucgaggccuuuaucgucgaacguagcgacacuccaacacuugugccgcaagaccguuaacggacauuuagacucguacgagaaggucacgcaacucccaggcccgaucagggaguucuuggaccaguacgacgcuccauuaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5872 - RNA, 759 nt, Artificial Sequence
  mRNA product Design5 comprising derived and/or modified sequence from Homo sapiens__NP_003227.1__HsTGFA (opt10)
gggagagucccgcagucggcguccagcggcucugcuuguucgugugugugucguugcaggccuuauucaagcuuaccauggugccgagcgccgggcaauuggcguuauuugccuuagggaucguccucgccgccugucaagcgcucgaaaauucgaccagucccuuaucggccgaucccccggucgccgccgccgucgucagucacuucaacgauuguccggacagucauacccaauuuuguuuucacgggacgugucgcuuccucguccaagaagauaaaccggccugcgugugucacagcggcuaugucggggccaggugcgaacacgccgauuuguuagcggucgucgccgcgucgcaaaaaaaacaagcgauaacggcgcucgucgucgugaguauagucgcguuagccguguugauaauaaccugcgucuuaauccauuguugucaagugaggaagcauugcgaaugguguagagcguugauauguagacaugaaaaaccgucggcguuguuaaaagggcgcacggccuguugucauagcgagaccgucgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5873 - RNA, 1449 nt, Artificial Sequence
  mRNA product Design5 comprising derived and/or modified sequence from Homo sapiens__NP_000651.3__HsTGFB1 (opt10)
gggagagucccgcagucggcguccagcggcucugcuuguucgugugugugucguugcaggccuuauucaagcuuaccaugcccccgucugguuuacgauuauuacccuuauuguuacccuuauugugguuauuaguauugacccccgggcgaccggccgccggcuuaaguacgugcaagaccaucgacauggaguuaguaaagcggaagcgaauagaggcgauacgagggcagaucuuaucgaaguuacgauuagccaguccgcccucgcagggcgagguaccgcccgggcccuugcccgaggccguauuagcguuauacaacaguacccgagaccgaguagcgggugagucugcggagcccgagcccgagcccgaggccgacuacuacgccaaggagguaacacgaguauugaugguagagacccacaacgagaucuacgacaaguucaagcagaguacgcacucuaucuacauguucuucaacacgagugaguuacgagaggcgguucccgagcccguauuauuaagucgagcggaguuacgauuauugcgauuaaaguuaaagguagagcagcacguagaguuauaccagaaguacaguaacaacucuuggcgauacuuaucaaaccguuuauuagcgccgucugacagucccgagugguuaucuuucgacguaacggggguaguacgacagugguuaagucgugggggcgagauagagggguuccgauugucagcgcacugcaguugcgacucucgggacaacacguugcagguagacaucaacggcuucacgacggggcgacgaggcgacuuagccaccauacacggcaugaaccgacccuucuuauuauuaauggccacgcccuuagagcgugcgcagcacuuacagucuagucgacaccgacgagccuuagacaccaacuacugcuucaguucgaccgagaagaacugcugcguacgacaguuauacaucgacuuccgaaaggacuuaggguggaaguggauacacgagccgaagggcuaccacgcgaacuucugcuuagggcccugccccuacaucuggucguuagacacgcaguacaguaagguauuagccuuauacaaccagcacaaccccggcgccucggcggccccgugcugcguaccgcaggcguuggagcccuuacccauaguauacuacguaggccguaagccgaagguagagcaguuaaguaacaugauaguacgaucgugcaagugcaguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5874 - RNA, 1521 nt, Artificial Sequence
  mRNA product Design5 comprising derived and/or modified sequence from Homo sapiens__NP_003229.1__HsTGFB2 (opt10)
gggagagucccgcagucggcguccagcggcucugcuuguucgugugugugucguugcaggccuuauucaagcuuaccaugcacuacugcguauuaucugcguucuugauauuacacuuaguuaccguggcauugaguuuauccacuugcaguacguuagacauggaccaguucaugcgaaagcgaauagaggcuauaaggggucagauuuugucgaagcucaaguuaacgucuccuccggaggacuaccccgagccggaagagguaccgccggagguaaucaguauauacaacucgacgcgagaccuuuuacaggaaaaggcaucgcgacgcgcagcggcgugcgagagggagcguucggacgaggaguacuacgcgaaggaaguauacaagaucgacaugccuccguucuucccgucggagaacgcgaucccaccuacguucuaucgaccguacuuccgcaucgucagguucgacguaagugcgauggagaagaacgccucuaacuuaguaaaggcggaguuucgaguauucagguuacagaacccgaaggcgcgaguucccgagcagaggaucgaguuauaccagaucuuaaagaguaaggaccuuacuucgccuacgcaacgauacauagacaguaagguaguaaagacgcgagccgagggagagugguuaucguucgacgucacggacgcgguccacgagugguuacaccacaaggaccgcaaccuuggcuucaagaucagucuccacugcccgugcugcacauucgucccuucgaacaacuauauaauaccgaacaagucggaggaguuagaggcucguuucgcgggaaucgacgggacgucgacguacacgucgggagaccagaagacgaucaagucgacgcgaaagaagaacucgggaaagacaccgcacuuguuauuaauguuguuaccgucguacagguuagagucgcagcagacgaaccgccgaaagaagcgagcgcuagacgcagcguacuguuuccgaaacguacaagacaacugcuguuuaaggcccuuauacaucgacuucaagcgcgacuuggguuggaaguggauccacgagccuaaggguuauaacgcaaacuucugcgcaggcgcgugccccuaccucuggucgucggacacccaacacagucgaguguuaucucuuuacaacacgaucaaccccgaggcgagugccucgccgugcugcgucucgcaggacuuggagccauuaacgaucuuguacuacaucgguaagacgccuaagaucgagcaguuaucgaacaugauagucaaaaguugcaagugcucaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5875 - RNA, 1515 nt, Artificial Sequence
  mRNA product Design5 comprising derived and/or modified sequence from Homo sapiens__NP_003230.1__HsTGFB3 (opt10)
gggagagucccgcagucggcguccagcggcucugcuuguucgugugugugucguugcaggccuuauucaagcuuaccaugaagaugcacuugcagagggcguugguaguauuagcguuauugaacuucgcgacgguaucguuaaguuuaucgacaugcacgacguuggacuucggccacaucaagaagaagcgcguagaggcgauacggggucagauauuaaguaaguuacgcuugacgucgccgccggagccgacgguaaugacacacguaccguaccagguauuagcguuauacaacaguacgagggaguuguuagaggagaugcacggugagcgcgaggaggguugcacgcaggagaacacggagucggaguacuacgcgaaggagauacacaaguucgacaugauacaggguuuagcggagcacaacgaguuggcgguaugccccaaggggauaacgaguaaggucuucagguucaacguaucgaguguagagaagaaccgcacgaacuuauucagggcggaguuccgaguauuaagggucccgaacccgucgaguaagcgaaacgagcagaggauagaguuauuccagauauuacgccccgacgagcacauagcgaagcagcgguacauaggggguaagaacuuacccacgcgcgguacggcugagugguugucguucgacguaacagacacgguaagggagugguuauuacgcagggagaguaacuugggcuuagagauaucgauacacugcccuugccacacguuccagccgaacggggacauauuagagaacauacacgagguaauggagauaaaguucaaggguguagacaacgaggacgaccacgggcgaggggacuuggggagguuaaagaagcagaaggaccaccacaacccccacuuaauauugaugaugauaccgccgcaccgauuagacaaccccggucagggggggcagcgaaagaagagggcguuagacacgaacuacugcuuccgaaacuuggaggagaacugcugcguaaggccguuauacauagacuuccgccaggacuuaggguggaaguggguacacgagccgaaggguuacuacgcuaacuucugcagugguccgugccccuacuugaggucggcagacacaacgcacaguacgguauuagguuuauacaacacguugaacccggaggcgucggcuaguccgugcugcguaccgcaggacuuagagcccuuaacaauauuguacuacguagggagaacgccgaagguagagcaguuaucgaacaugguaguaaagucgugcaagugcaguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5876 - RNA, 1662 nt, Artificial Sequence
  mRNA product Design5 comprising derived and/or modified sequence from Homo sapiens__NP_001057.1__HsTNFRSF1B (opt10)
gggagagucccgcagucggcguccagcggcucugcuuguucgugugugugucguugcaggccuuauucaagcuuaccauggccccgguggcggucugggcggcuuuagcgguagggcuugagcuuugggcggccgcgcacgcguuaccggcgcaggucgcguucacgcccuacgcucccgagccggguucaacgugcagguugcgcgaguacuacgaccaaacugcgcagaugugcugcucgaagugcuccccgggacagcacgcgaagguauucugcaccaaaacaucagacacggugugcgacucgugcgaggacucgacuuacacgcaauuauggaacugggugcccgagugccucucgugcggaucgcgaugcucgucagaccaaguagagacccaggccugcacgcgcgagcaaaaccggaucugcacgugccgcccgggcugguacugcgccuugucgaagcaggaggguugccgacucugcgcgccccuccgaaagugccggccggguuucgggguagcgcgaccugggacggagacgucggacguagucugcaagccgugcgcgcccggaacauucucuaacacgacaucgucuaccgacaucugccgcccgcaccagaucugcaacgucguugcaaucccggggaacgcgaguauggacgcgguaugcacaucgacgucgccgacgcgcucaauggcgccgggcgccgugcaccuuccgcagcccguaucgacgcggucgcagcacacccaaccgacgccggagccgucgaccgcgccgucgacuucguuccuuuuacccauggggcccucgccgcccgcggagggcucgaccggugacuucgcguugccgguaggguuaaucgugggcgucacggcguuaggguuguuaaucaucggcgucguaaacugcgugauaaugacgcagguaaagaagaagccgcugugcuugcagcgagaggcgaaggugccgcacuuaccggccgacaaggcccguggcacgcagggucccgagcagcagcacuuauuaauuaccgcgccgucgucgaguucgaguucguuggagucgagcgcaucggcccuagacaggcgagcccccacgcgaaaccagccgcaggcgccggguguggaggcgucuggggccggcgaggcccgugccucgaccggaucgucggacucgucgccgggcggacacgguacacagguaaacguaacuugcaucguuaacguaugcucgucgucggaccacucgagucagugcucgagucaggcgucgucgacgaugggggacacugacucgucgcccucagagaguccuaaggacgagcaggucccguucucgaaggaggagugcgccuuccguagucaacucgagacaccggagacgcuccucggaucaacggaggagaagccguuacccuuaggcguuccggacgcggggaugaagccgucgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5877 - RNA, 789 nt, Artificial Sequence
  mRNA product Design5 comprising derived and/or modified sequence from Homo sapiens__NP_002623.2__HsPGF (opt10)
gggagagucccgcagucggcguccagcggcucugcuuguucgugugugugucguugcaggccuuauucaagcuuaccaugcccguaaugcgcuuauuuccauguuucuugcaguuauuagcgggcuuggccuuacccgcaguaccaccgcaacaaugggcucucucggcagggaacgguaguucggaaguugaggucgucccguuccaggaggucuggggucgaaguuacugcagggcccuugagcgccucguggacguaguaagugaguauccgagugagguagagcauauguucucgccuaguugcguuucuuuauugagguguacagguugcugcggugacgagaacuuacacugcguacccguagagaccgccaacguaacuaugcaauuauugaagauucgaucgggagaccguccaucguacguagaguuaaccuuuagucagcauguccguugcgagugccguccgcuucgcgagaaaaugaagcccgagcgucgaaggccuaaagggcgcgggaagcggcgcagggagaaacagcgaccuacggacugucacuugugcggggacgcggucccgcgacgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5878 - RNA, 1515 nt, Artificial Sequence
  mRNA product Design5 comprising derived and/or modified sequence from Homo sapiens__NP_001020537.2__HsVEGFA (opt10)
gggagagucccgcagucggcguccagcggcucugcuuguucgugugugugucguugcaggccuuauucaagcuuaccaugaccgaccgccagaccgacacggcccccucgccguccuaccaccucuuacccggccggcgccggaccguggacgccgcggccucgcgcgggcagggccccgagcccgcccccgggggcggggucgagggcgugggcgcccgcgggguggccuuaaaguuauucguccagcucuuaggcugcucccgguucgggggcgcgguggugcgggccggggaggccgagcccucgggcgccgcgcgcuccgccucguccggccgggaggagccccagcccgaggagggggaggaggaggaggagaaggaggaggagcgcggcccgcaguggcgguuaggggcccgcaagcccggcucguggaccggcgaggccgccgucugcgcggacuccgcccccgccgcccgggccccgcaggcgcucgcccgcgccucggggcggggcgggcgcguggcccggcgcggcgccgaggaguccgggccgccccacucgcccucccggcgcggcucggcgucccgggccggccccgggcgcgccucggagaccaugaacuucuuauuauccugggugcacuggucgcucgccuuauuacucuacuuacaccacgccaaguggucccaggcggccccgauggccgagggcgggggccagaaccaccacgaggucgugaaguucauggacguguaccagcgcucguacugccaccccaucgagacguuagucgacaucuuccaggaguaccccgacgagaucgaguacaucuucaagcccucgugcgugccgcucaugcggugcgggggcugcugcaacgacgagggcuuagagugcgugcccaccgaggaguccaacaucaccaugcagaucaugcgcaucaagccccaccaggggcagcacaucggcgagaugucguucuuacagcacaacaagugcgagugccggcccaagaaggaccgcgcccggcaggagaagaaguccguccgcgggaagggcaaggggcagaagcggaagcgcaagaagucccgguacaagucguggucgguguacgugggcgcgcgcugcugccucaugccgugguccuuacccggcccccaccccugcgggccgugcucggagcggcgcaagcacuuauucguccaggacccgcagacgugcaagugcucgugcaagaacacggacucgcggugcaaggcgcgccagcucgaguuaaacgagcggacgugccgcugcgacaagccgcggcgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5879 - RNA, 975 nt, Artificial Sequence
  mRNA product Design5 comprising derived and/or modified sequence from Homo sapiens__NP_001165094.1__HsVEGFA (opt10)
gggagagucccgcagucggcguccagcggcucugcuuguucgugugugugucguugcaggccuuauucaagcuuaccaugaacuucuuauugucguggguccacuggaguuuagcguuauuguuauacuuacaccacgcgaaguggucgcaagcagcgccgauggcggagggggguggucaaaaccaccacgagguaguaaaguucauggacguguaccagaggucguacugccacccgauagagacguugguagacauauuccaagaguacccggacgagaucgaguacaucuucaagccgucgugcguaccguuaaugcgcugcggugguugcugcaacgacgaggguuuagagugcgucccuacggaggagaguaacaucacuaugcagauaaugaggauuaagccgcaucaagggcagcacauaggggagaugucguucuugcagcauaacaagugcgagugccgaccgaagaaggaccgagcgcgacaggagaagaagaguguaagggguaaagggaagggucaaaagcgcaagaggaaaaagagucgauacaagucguggucgguauacgucggggccaggugcugcuuaaugccguggucguuaccagggccgcacccgugcgggccgugcucggagcgcaggaagcacuuauucguacaggacccacagacgugcaagugcaguugcaagaacacggacucgcguugcaaggcacgacaguuagaguuaaacgagcgaacgugccggugcgacaagccucgaaggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5880 - RNA, 900 nt, Artificial Sequence
  mRNA product Design5 comprising derived and/or modified sequence from Homo sapiens__NP_003368.1__HsVEGFB (opt10)
gggagagucccgcagucggcguccagcggcucugcuuguucgugugugugucguugcaggccuuauucaagcuuaccaugucgccguuauugaggagguuauuauuggcggccuuguuacaauuagcgccggcgcaagcgccggugagucaaccggacgcgccggggcaucaacgcaaggucgucagcuggaucgacgucuacaccagggccacgugucaaccgagagaagucgucgucccgcucaccgucgaauugauggggacggucgcgaagcaauuagucccgucgugugucaccguccaaaggugcgggggguguuguccggaugacggguuagaaugcgucccgaccggccaacaucaggugagaaugcaaauauugaugauaagauaucccucgucgcaauuaggcgaaaugaguuuagaggagcauucgcaaugcgagugucgcccgaagaagaaagauucggccgucaaaccggaucgcgccgcgaccccgcaucauaggccgcaaccgaggagcguccccgggugggauagcgcgccgggggccccgaguccggccgauauaacgcacccgaccccggcgccggggccgagcgcgcaugccgccccgucgacgacgucggcguuaacgccggggccggcggccgcggccgcggaugcggccgccaguagugucgcgaaagggggcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5881 - RNA, 1536 nt, Artificial Sequence
  mRNA product Design5 comprising derived and/or modified sequence from Homo sapiens__NP_005420.1__HsVEGFC (opt10)
gggagagucccgcagucggcguccagcggcucugcuuguucgugugugugucguugcaggccuuauucaagcuuaccaugcaccucuuaggguucuucagcgucgccugcuccuuacuggcggcggcccuccugcccgggccgcgcgaggccccggcggcggcggcggcguucgagagcggccuggaccucuccgacgccgagccggacgcgggggaggcgaccgccuacgccucgaaggacuuagaggagcagcugcgguccgucagcuccguggacgagcucaugaccgugcuguaccccgaguacuggaagauguacaagugccaguugcgcaagggcggguggcagcacaaccgggagcaggcgaaccucaacagccgcacggaggagaccaucaaguucgcggccgcccacuacaacaccgagauccucaaguccaucgacaacgaguggcggaagacccagugcaugccgcgcgaagucugcaucgacgucggcaaagaguucggcguggccacgaauacguuuuucaagccgcccugcgucaguguguaucggugcgggggcuguuguaacuccgaaggguuacaauguaugaauacgucgaccucguauuuaucgaaaacgcuguucgagaucaccguccccuugucccaggggccgaagcccgucaccauaucguucgcgaaccauaccucgugucgcuguaugagcaaguuagacguguaucgccaggugcacucgaucauccggcggaguuuacccgcgacguugccccaaugccaagccgccaauaaaacguguccgacgaacuauauguggaacaaccauauaugucgcuguuuagcccaagaggacuucauguucaguuccgacgccggggacgauagcaccgacggcuuucacgauauaugcggccccaauaaagaauuagacgaggaaacgugccaaugcgucugucgggcgggguugcgccccgcgucgugcggcccgcauaaggagcucgaucggaauagcugucaaugcgugugcaagaauaaguuguuuccgucgcagugcggggcgaaucgcgaguucgacgagaauacgugucaaugcgugugcaagcggacguguccgcgcaaccagccguugaaccccggcaagugcgcgugcgagugcaccgagucgccgcaaaagugucuccugaagggcaagaaauuucaucaucagaccuguucgugcuaucggcgccccugcaccaaucggcaaaaagccugcgaacccggguucagcuacuccgaggaggucugccgcugcgugcccagcuacuggaagcgcccgcagaugucgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5882 - RNA, 1341 nt, Artificial Sequence
  mRNA product Design5 comprising derived and/or modified sequence from Homo sapiens__NP_004460.1__HsVEGFD (opt10)
gggagagucccgcagucggcguccagcggcucugcuuguucgugugugugucguugcaggccuuauucaagcuuaccauguacagggaaugggucguagucaacgucuucaugauguuauacguacaauuaguacaagguucgucgaacgagcacgguccggucaagcguucgucgcaaucgacguuagagcguucggagcagcagauacgagcggcgucgucguuagaggaguugcuacggauaacgcacucggaggacuggaaguuauggcgaugucgauuacgcuuaaagucguucacaucgauggacucgaggucggcuucgcaccgcucgacgcgguucgccgcgacauucuacgacauagagacguuaaaggucaucgacgaggaguggcagcgcacgcagugcucgccgagggagacuugcgucgaggucgcgucagaauuggguaagucgacuaacacguuuuucaagccuccgugcguuaacgucuuccguugcggggguugcugcaacgaggagucguuaaucugcaugaacacaaguacgucauacaucucgaagcaauuauucgagaucucggucccauuaaccucggucccggaguuggugccgguaaagguagcgaaccacacggggugcaagugcuuaccgacggcuccgcgacacccguacaguauaauacgacggucgauacagauucccgaggaggaccgaugcagucacucgaagaagcuaugcccaaucgacaugcucugggacaguaacaagugcaagugcguauuacaggaggagaaccccuuggcggggacggaggaccacucgcacuugcaggagccggcguugugcggaccgcacaugauguucgacgaggaccggugcgagugcguaugcaagacuccgugcccgaaggacuugauucagcacccuaagaacugcucgugcuucgaaugcaaggagucguuagagacgugcugccagaagcacaaguuguuccacccggauacaugcaguugcgaggaccgaugcccguuccacacacgacccugcgcgucggguaagacggcuugcgcgaagcacugccgauucccuaaggagaagcgagcggcacaggguccgcacucucguaagaacccgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5883 - RNA, 924 nt, Artificial Sequence
  mRNA product Design5 comprising derived and/or modified sequence from Homo sapiens__NP_002119.1__HsHMGB1 (opt10)
gggagagucccgcagucggcguccagcggcucugcuuguucgugugugugucguugcaggccuuauucaagcuuaccauggguaaaggugacccgaaaaagccacgcgguaagaugaguucguaugcguucuucguccaaacgugccgagaggaacacaagaaaaagcacccggacgcgucgguaaacuucucggaguucucaaaaaagugcuccgaacgcuggaagacgaugucggcgaaagagaaagguaaauuugaagauauggcgaaagcggacaaggcgcgcuacgagagggagaugaagacauauauaccgccgaagggugagaccaagaaaaaguucaaggacccgaacgcgccgaagcggccgccgucugcguuuuuccuuuucuguucggaguaccgcccgaagauaaagggagagcacccgggccuuucgauaggcgacguagcgaaaaaguugggugaaauguggaauaacacggcggcggacgauaaacagccauaugaaaagaaagcagcgaagcucaaggaaaaguacgagaaagauaucgcggcauaucgagcaaaagguaaaccggacgcggcgaagaaagguguaguaaaagcagaaaagucgaagaaaaagaaagaggaagaggaagaugaagaggacgaggaagaugaagaggaagaggaagaugaagaggacgaggacgaggaagaggacgaugacgaugaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5884 - RNA, 1191 nt, Artificial Sequence
  derived and/or modified CDS sequence (opt11) from Homo sapiens__NP_001191.1__HsBMP2
auggucgccggcacccguugccuccuugcccuccuccuaccccaaguccuacuaggcggagcagccggccucguccccgaacucggccgccgcaaauucgccgccgccucauccggacgccccuccucacaacccagcgacgaaguacucucagaauuugaacuucgucuacucuccauguucggccucaaacaacgacccacucccucccgcgacgcagucguccccccuuacaugcuagaccuuuaccgccgccacuccggccaacccggaucacccgcccccgaccaucgccucgaaagagccgccucccgagccaauaccguccgcucauuccaccacgaagaaucacucgaagaacuacccgaaaccagcggaaaaacaacacgcagauucuucuucaaccucuccagcauccccaccgaagaauuuaucaccuccgccgaacuacaaguauucagagaacaaaugcaggacgcccucggcaacaacuccagcuuccaccaccgcaucaacauauacgaaauaaucaaacccgccacagcuaacuccaaguuccccgucacacgccuacucgacacccgccuagucaaccaaaaugccucccgcugggaauccuucgacgucacccccgccgucaugcgauggaccgcacaaggccacgccaaucacggcuucgucguagaaguugcacaccuagaagaaaaacaaggcgucuccaaacgccacguccgcaucuccagaucccuacaccaagacgaacacucauggucccaaauccgcccccuccuagucaccuucggacaugacggcaaaggacacccgcuccacaaacgcgaaaaacgccaagccaaacacaaacaacgcaaacgccucaaaucauccugcaaacgccacccacucuacguagacuucuccgacguaggauggaacgacuggauagucgcacccccaggcuaccacgcauucuacugccacggagaaugcccauucccacuugccgaccaccucaacuccaccaaccacgcuaucguacaaacacucgucaacuccgucaacucaaaaaucccaaaagcaugcugcguccccacagaacucucagccaucuccaugcucuaccucgacgaaaacgaaaaggucguccuaaaaaacuaccaagacauggucgucgaaggcugcggcugccgcuag

SEQ ID NO: 5885 - RNA, 1296 nt, Artificial Sequence
  derived and/or modified CDS sequence (opt11) from Homo sapiens__NP_001710.1__HsBMP7
augcacguccgaucacuacgcgccgcagccccacacuccuucguagcacucugggcaccccuauucuuacuccgcuccgcacuagccgacuucucccucgacaacgaaguccacucgagcuucauccaccgccgccuacggucccaagaaagacgcgaaaugcaacgcgaaauccucucaauucuaggacucccccaccgcccccgcccccaccuccaaggcaaacacaacucugcccccauguucaugcucgaccucuacaacgccauggcaguagaagaaggaggcggacccggcggccaaggcuucucauaccccuacaaagccguuuucucaacccaaggcccgccccucgcaucccuccaagacucacacuuccuaaccgacgccgacaugguaaugucauucgucaaccucguagaacaugacaaagaauuuuuccacccccgcuaucaccaccgcgaauuucgauucgaccucucgaaaauacccgaaggcgaagccgugaccgcagccgaauuucgcauauacaaagacuacauccgcgaacgcuucgacaacgaaacauuccgcaucuccgucuaccaagugcuccaagaacaccucggccgcgaaagcgaccucuuccuacuugacucccgcacacuuugggccucugaagaagguuggcucguauucgacauaacagccaccucaaaccacuggguagucaacccccgucacaaccuaggacuccagcuaucaguagaaacacucgacggccagagcaucaaccccaaacuugcgggacucaucggccgccacggaccacaaaacaagcagcccuucauggucgccuucuuuaaagccaccgaaguacauuucagauccauacgcuccaccggguccaaacaacgaucacaaaaccgauccaaaaccccaaaaaaccaagaagcucuacgaauggcaaacguagcugaaaacagcuccucagaccaacgccaagccugcaaaaaacacgaacucuacgucuccuuccgagaccucggcuggcaagacuggaucaucgccccagaaggcuacgcagcauacuacugcgaaggcgaaugcgccuucccccuuaacucuuacaugaacgccaccaaccacgcaaucguccagacccucguacacuucaucaaccccgaaacuguccccaaacccugcugcgcccccacccaauuaaacgcaaucuccguccucuacuucgacgacuccucgaacgucauacucaaaaaauaccgaaacauggucguccgcgccugcggcugccauuaa

SEQ ID NO: 5886 - RNA, 300 nt, Artificial Sequence
  derived and/or modified CDS sequence (opt11) from Homo sapiens__NP_006264.2__HsCCL7
augaaagccuccgccgcccuccucugccuccuccucaccgccgccgccuucuccccccaaggccuagcccaacccgucggcaucaacaccuccaccaccuguugcuaccgauucaucaacaaaaaaauccccaaacaacgccucgaauccuaccgccgcaccaccuccucacacugcccccgcgaagccgucaucuucaaaaccaaacucgacaaagaaaucugcgccgaccccacccaaaaauggguccaagacuucaugaaacaccucgacaaaaaaacccaaacccccaaacucuaa

SEQ ID NO: 5887 - RNA, 585 nt, Artificial Sequence
  derived and/or modified CDS sequence (opt11) from Homo sapiens__NP_002000.1__HsFGF7
augcacaaauggauccucaccuggauccuccccacccuccucuaccgcuccugcuuccacaucaucugccucgucggcaccaucucccucgccugcaacgacaugacccccgaacaaauggccacaaacgucaacugcuccucccccgaacgccacacccgcuccuacgacuacauggaaggcggcgacauccgcguccgccgacucuucugccgcacccaaugguaccuacgcaucgacaaacgcggcaaaguaaaaggcacccaagaaaugaaaaacaacuacaacaucauggaaauccgcacagucgccgucggcauagucgcaaucaaaggcgucgaauccgaauuuuaccucgccaugaacaaagaaggcaaacucuacgccaaaaaagaaugcaacgaagacugcaacuucaaagaacucauccucgaaaaccacuacaacaccuacgccuccgccaaauggacccacaacggcggcgaaauguucgucgcccucaaccaaaaaggcauccccguccgcggcaaaaaaaccaaaaaagaacaaaaaaccgcccacuuccuccccauggccaucaccuaa

SEQ ID NO: 5888 - RNA, 1104 nt, Artificial Sequence
  derived and/or modified CDS sequence (opt11) from Homo sapiens__P48741__HsHSPA7
augcaagccccccgcgaacuagccguaggcaucgaccucggcacaaccuacagcugugucggcguauuccaacaaggcagaguagaaauccuagccaacgaccaaggcaacagaacgaccccaucauacgucgcguucaccgacacagaaaggcuaguaggagacgcagcaaaaucccaagcagcccuaaacccgcacaacacuguauucgacgccaaacgccuaaucggacgaaaauucgcagacacaaccguccaaucagacaugaaacacuggccauuccaagucgucuccgaagguggaaaacccaaaguacgaguaugcuaccgaggggaagacaaaacauucuacccagaagaaauaagcucaaugguacuaagcaaaaugaaagaaaccgcggaagccuaccuaggccaaccaguaaaacacgccguaaucacggucccgaccuacuucagcaacucccagagacaggccaccaaagacgcaggagcaaucgcaggccuaaaaguacucccaaucauaaacgaagccacagccgcagcaauagccuacggccuggaccgaagaggagccggcaaacgaaacguacucauauucgaccuaggaggaggaacauucgacguauccguacucucgaucgacgccggggucuucgaaguaaaagcuaccgccggcgacacccaccuaggaggcgaagacuucgacaaccgccuagucaaccacuucauggaagaauuucgcagaaaacacggcaaagaccuaagcggaaacaaacgagcccucagacgacuccgaacagccugcgaacgagccaaacgcaccccaucaagcagcacccaggccacacuagaaaucgacucccuauucgaaggcguagacuucuacaaaagcaucaccagagccagauucgaagaacucugcagcgaccuauuccgaagcacccuagaacccguggaaaaagcccuccgcgacgccaaacuagacaaagcacaaauccacgacuucguacuaggcggcgggcuccacagccacccacaaggcgcagaagucgccgcaggccuacuccaacgacaaggcgcagaacaagaacaccagccauaa

SEQ ID NO: 5889 - RNA, 2175 nt, Artificial Sequence
  derived and/or modified CDS sequence (opt11) from Homo sapiens__NP_031381.2__HsHSP90AB1
augcccgaagaagugcaccacggggaagaggaagucgaaaccuucgccuuccaggccgagauagcccaacucaugagcuuaaucauaaacaccuucuacuccaacaaagaaaucuuccucagagaguugauaucaaacgcaagcgacgcccuggacaagauaagauacgaaagccuaacagacccaucaaaacuggacucaggaaaggaguuaaaaauagacaucaucccaaacccacaagaacgcacgcucacccucguggacaccggaauaggaaugacaaaagccgaccucauaaacaaucucggcacgauagccaagagcgggacaaaagccuucauggaggcccuacaagcaggagccgacauaagcaugaucggacaauucggcguaggcuucuacagcgcauaccucgucgccgaaaaggugguaguaaucacaaaacacaacgacgacgaacaauacgccugggaaagcagcgccggcgggagcuucacagucagagcagaccacggcgaaccuauaggacgcgggacuaaaguaauccuccaccuaaaggaagaccaaaccgaauacuuagaagaacgcagggucaaggaagucgucaaaaaacacagccaguucaucggcuaccccauaacccucuaccuggaaaaagagagggaaaaggaaauaagugacgacgaggccgaggaagaaaaaggagaaaaagaagaagaagacaaagacgacgaagaaaagcccaagaucgaagacguaggaagcgacgaagaagacgacucaggaaaggacaagaaaaaaaaaacgaaaaaaaucaaagagaaauacaucgaccaagaagaacugaacaaaacaaaaccaaucuggaccaggaaccccgaugacaucacacaagaagaauacggggaauuuuacaaaucgcuaacaaacgacugggaggaccaccucgcgguaaagcacuucagcguggaaggacaacucgaauuuagagcacuacuauucaucccaaggagagcgccauucgaccuguucgaaaacaagaaaaaaaaaaacaacauaaagcuauacguccgacgagucuucauaauggacucaugcgacgaacugaucccagaauaccuaaacuucauccggggcguaguagacuccgaagaccucccacucaacaucagccgagaaaugcuacaacagagcaagauacugaaagugaucagaaaaaacaucguaaaaaagugccuagaacuauucagcgaauuagcagaggauaaagaaaacuacaagaaauucuacgaagccuucagcaagaaccuaaaacugggcauacacgaagacagcaccaaucgaaggcgccuaagcgaacuacuaagauaccacacaagucagagcggcgacgagaugacgagccuauccgaauacguuagccggaugaaagaaacgcaaaagucaauauacuacaucaccggagagagcaaggaacaaguagcgaacucggcauucgucgaacgcgugcgaaagcgcggauucgaagucguauacaugacggagcccaucgacgaguacuguguacaacagcucaaagaauuugacggcaaaagccuagucucaguaaccaaagaaggacuagaauugcccgaagacgaagaagagaagaaaaaaauggaagaaucaaaagccaaauucgagaacuugugcaagcugaugaaagagauccuagacaaaaagguagaaaaggucacgaucucaaaccggcuggugagcucgcccugcugcaucgucacgagcacauacggcuggacagcaaacauggaacgaauaaugaaagcacaagcccucagagacaacucaaccaugggguacaugauggccaagaaacaccucgaaauaaaccccgaccacccuauaguagaaacgcucaggcaaaaggccgaagcagacaaaaacgacaaagccguaaaagaccucgugguccugcucuuugaaacagcccuacucucaagcggauuuucacuggaggacccacaaacccacagcaacagaaucuaccgaaugauuaagcucggacuggguauugacgaggacgaaguagccgcggaagaacccaacgcggcaguccccgacgaaaucccgccccuggaaggggacgaggacgcaucaagaauggaagaggucgacuag

SEQ ID NO: 5890 - RNA, 639 nt, Artificial Sequence
  derived and/or modified CDS sequence (opt11) from Homo sapiens__NP_000591.1__HsIL6
augaacuccuucuccaccuccgccuucggccccgucgccuucucccucggccuccuacucguacuccccgccgccuucccagcccccguccccccaggcgaagacuccaaagacgucgccgccccccaccgccaaccucucaccucauccgaacgcaucgacaaacaaauacgcuacauccucgacggcaucuccgcccuccgcaaagaaaccugcaacaaaucaaacaugugcgaauccucaaaagaagcccucgccgaaaacaaccuaaaccuccccaaaauggccgaaaaagacggcugcuuccaauccggcuucaacgaagaaacaugccucgucaaaauaaucaccggacuccucgaauuugaagucuaccucgaauaccuacaaaaccgcuucgaaucauccgaagaacaagcccgcgccguccaaaugucaaccaaaguccucauccaauuccuccaaaaaaaagccaaaaaccucgacgccaucacaacccccgaccccaccaccaacgccucccuacucaccaaacuccaagcccaaaaccaauggcuccaagacaugaccacccaccucauccuccgcuccuucaaagaauuucuccaauccucccuccgcgcccuccgacaaauguag

SEQ ID NO: 5891 - RNA, 1416 nt, Artificial Sequence
  derived and/or modified CDS sequence (opt11) from Homo sapiens__NP_002418.1__HsMMP13
augcaccccggcguacucgcagccuuccuauuccuauccuggacccacugccgcgcauuaccccuccccucaggaggcgaugaagacgaccuuuccgaagaagaccugcaauucgccgaacgcuaccuccgauccuacuaccaccccaccaaccucgccggcauacucaaagaaaacgcagccucauccaugacagaacgccuccgcgaaaugcaauccuucuuuggccucgaagucaccggaaaacuugacgacaacacgcuagacgucaugaaaaaacccagaugcggaguccccgacgucggcgaauacaacgucuuccccagaacccuaaaauggucaaaaaugaaccucaccuacagaauagucaacuacaccccugacaugacccacuccgaaguagaaaaagccuucaaaaaagccuucaaagucuggucugacguuaccccccucaacuucacccgacuccacgacggcaucgccgacauaaugaucuccuucggaaucaaagaacacggcgacuucuaccccuucgacggaccaucaggccuacucgcccacgccuucccaccaggacccaacuacggaggcgacgcccacuucgaugacgacgaaaccuggaccuccuccuccaaaggcuacaaccucuuccuaguagccgcacacgaauuuggccacucacuaggacuagaccacuccaaagaccccggcgcucuuauguuccccaucuacaccuacacugggaaaucccacuucaugcuccccgacgacgacguacaaggcauccaaagccucuacggcccgggcgacgaagaucccaaccccaaacaccccaaaacaccagacaaaugcgaccccucacuaucacuagacgcaaucaccucccuccguggcgaaacuaugaucuucaaagaccgauucuucuggcgcuuacacccccaacaagucgacgccgaacucuuccuuaccaaaucauucuggcccgaacuccccaaccgcaucgacgccgccuacgaacaccccagccaugaccucaucuuuaucuuccgcgggagaaaauucugggcacuaaacggauacgacauacucgaaggcuacccaaaaaaaaucuccgaacuaggccucccaaaggaagucaaaaagaucuccgcagcaguacacuucgaagacaccggcaaaacccuccuauucucagguaaccaaguauggcgcuacgacgacaccaaccacaucauggacaaagacuacccccgccucaucgaagaagacuuccccggcauaggcgacaaagucgacgccgucuaugaaaaaaacggcuacauauacuucuuuaacggccccauccaauuugaauacuccauaugguccaaccgcaucguacgcguuaugccagccaacuccauccucuggugcuaa

SEQ ID NO: 5892 - RNA, 1095 nt, Artificial Sequence
  derived and/or modified CDS sequence (opt11) from Homo sapiens__NP_149126.1__HsPDGFD
augcaccgccuaaucuucgucuacacccuaaucugcgccaacuucugcuccugccgagacaccuccgccaccccacaauccgccuccauaaaagcacuccggaaugccaacuuacgccgggacgaccuauaccgucgagacgaaacaauccaaguaaaaggaaacggcuacgugcaaucgccccgauucccaaacuccuacccacgcaaccuccuccucaccuggcgacuacacucccaagaaaacacucgcauccaacucgucuucgacaaccaguucggccuggaagaagccgaaaacgacaucugccgcuacgacuucgucgaagucgaagacauaucagaaaccuccaccaucauacgcggccgcuggugcggccacaaagagguacccccccgcaucaaaucccgcacaaaccaaaucaaaauaaccuucaaaucagacgacuacuucguagcuaaacccggauucaaaaucuacuacucccuccuagaagacuuccaacccgccgcagcauccgagaccaacugggaauccguaaccuccuccauauccggcguauccuacaacagccccuccgucacagaccccacccuuauagccgacgcccucgacaaaaaaaucgccgaauuugacaccgucgaagaucuccuaaaauacuucaaccccgaaucauggcaagaagaccucgaaaacauguaccuagacaccccacgauaccgcggacgcucauaccacgaccgaaaauccaaagucgaccucgaccgacucaacgacgacgccaaacgcuacagcugcacaccacgcaacuacuccgucaacauccgcgaagaacuaaaacucgccaacguagucuucuucccccgcugccuucucguccaaagaugcggcggcaacugcggcuguggaaccguaaacuggcgcagcugcaccuguaacucaggcaaaaccgucaaaaaauaccacgaaguccuccaauucgaaccaggccacaucaaacgccgcggccgagccaaaacaauggcccucgucgacauccagcucgaccaccacgaacgcugcgacugcauaugcuccagccgccccccucgcuaa

SEQ ID NO: 5893 - RNA, 678 nt, Artificial Sequence
  derived and/or modified CDS sequence (opt11) from Homo sapiens__NP_003946.3__HsSOCS3
auggucacccacuccaaauucccugccgcaggcaugucccgaccccucgacaccucccuccgacucaaaaccuucuccucaaaguccgaauaccaacucgucgucaacgccguccguaaacuccaagaauccggcuucuacugguccgccgucaccgguggugaagcaaaccuccuccucuccgcagaacccgccggcaccuuccucauccgcgacuccucagaccaacgccacuucuucacccucucagucaaaacccaauccggcaccaaaaaccuccgcauccaaugcgaaggcggcuccuucucccuccaauccgacccacgcuccacacaaccugucccacgcuucgacugcguccucaaacucguccaccacuacaugccaccccccggcgcccccuccuucccauccccccccaccgaacccuccucagaaguccccgaacaacccucagcccaaccccuccccggcucccccccccgccgcgcauacuacaucuacuccggcggcgaaaaaaucccacucguacucucccgcccccucuccuccaacgucgccacccuacaacaccucugccgcaaaaccgucaacggccaccucgacuccuacgaaaaagucacccaacuacccggccccauccgcgaauuucucgaccaauacgaugcaccccuauaa

SEQ ID NO: 5894 - RNA, 483 nt, Artificial Sequence
  derived and/or modified CDS sequence (opt11) from Homo sapiens__NP_003227.1__HsTGFA
augguccccuccgccggccaacucgcccuauucgcccucggaaucguccucgcagccugccaagcccucgaaaacuccaccuccccccucuccgccgacccccccgucgccgccgccgucgucucccacuucaacgacugccccgacucccacacccaauucugcuuccacggcaccugucgcuuccucguccaagaagacaaacccgccugcgucugccacuccggcuacgucggcgcccgcugcgaacacgccgaccuccucgccgucgucgccgccucccaaaaaaaacaagccaucaccgcccucgucgucgucuccaucgucgcccucgccguccucaucaucaccuguguccuaauccacugcugccaaguccgcaaacacugcgaauggugccgcgcccucaucugccgccacgaaaaacccuccgcccuccucaaaggccgcaccgccugcugccacuccgaaacagucguuuaa

SEQ ID NO: 5895 - RNA, 1245 nt, Artificial Sequence
  derived and/or modified CDS sequence (opt11) from Homo sapiens__NP_003229.1__HsTGFB2
augcacuacugcguccucuccgccuuccucauauuacaccucgucaccguugcccuaucccucucgacuugcuccacccucgacauggaccaauucaugcgcaaaagaaucgaagcaauccgaggccaaauccucucaaaacucaaacuuacaucccccccugaagacuauccagaacccgaggaaguccccccugaagucauauccauauacaacagcacccgcgaccuacuccaagaaaaagccucgcgacgagccgcagccugcgaacgcgaacgcagcgacgaagaauacuacgccaaggaagucuacaaaaucgacaugccgcccuucuucccaucagagaaugcuaucccccccaccuucuaccgaccauacuuccgcaucguccgcuucgacgucuccgcaauggaaaaaaacgccuccaaccucgucaaagccgaauuucgcgucuuccgccugcaaaaccccaaagcccgcguucccgaacaacgcaucgaacucuaccaaauacucaaauccaaagaccucaccucucccacccaacguuacaucgacucuaaaguagucaaaacacgcgccgaaggcgaauggcucuccuucgacguaaccgacgccguacacgaauggcuccaccacaaagacagaaaccucggauucaaaaucucccuacacugccccugcugcacuuucguccccuccaacaacuacauaauucccaacaaauccgaagaacuugaagcccgcuucgccggcaucgacggaaccucgaccuacacuucaggcgaccagaaaaccauuaaauccacccgcaaaaaaaacucgggcaaaacaccccaccuccuacucaugcuccucccauccuaccggcuagaaucccaacaaaccaaccgacgcaaaaaacgagcccucgacgcagccuacugcuuccguaacguccaagacaauugcugccuacgcccacucuacaucgauuucaaacgugaccucggauggaaauggauccaugaacccaaaggcuacaacgccaacuucugcgcaggcgcaugccccuaccucuggagcuccgacacccaacacucccgcguccuaagccuuuacaacaccaucaaccccgaagccucagccucccccugcugcgucucccaagaccucgaaccacuaacaauccucuacuacaucggcaaaacccccaaaauagaacaacucuccaacaugaucgucaaauccugcaaaugcuccuaa

SEQ ID NO: 5896 - RNA, 1386 nt, Artificial Sequence
  derived and/or modified CDS sequence (opt11) from Homo sapiens__NP_001057.1__HsTNFRSF1B
auggcaccagucgcagucugggccgcccucgccguaggccuugaacucugggcagccgcccacgcccucccagcacaagucgcauucacucccuacgcacccgaacccggcuccaccugucgccuacgcgaauacuaugaccaaacagcacaaaugugcugcuccaaaugcucucccggccaacacgcuaaaguauucugcacaaaaaccucugacaccguaugcgacucaugcgaagacuccacauauacccaacucuggaacuggguccccgaaugccucuccugcggcucccgcugcagcucagaccaaguagaaacccaagcaugcacccgcgagcaaaaccgcaucugcacaugccgccccggcugguacugcgcucucuccaaacaagaaggcugcagacuuugugcaccucugaggaaaugccgaccaggcuuugguguagcaagacccgguaccgaaaccucagacgucgucugcaaaccgugugcacccggcaccuucucaaacaccaccuccucuaccgacaucugccgaccacaucaaaucugcaacguagucgccaucccaggcaacgccuccauggacgccguaugcaccucgaccucccccacccgcuccauggcccccggcgccguacaccuaccccaacccgucuccacccgaucccagcacacccaacccaccccagaacccagcaccgccccgucaaccucauuccuacucccaaugggccccuccccacccgcagaaggcuccacaggcgauuucgcccuccccguaggacuaauaguuggcgucaccgcccuaggccuccuuaucaucggcguagucaacugcgucaucaugacccaagucaaaaaaaaaccccucugccuccaacgcgaagccaaagucccacaccucccagccgacaaagcccgcggaacccaaggccccgaacaacaacaccuccucaucaccgcccccucaucaagcuccuccucacucgaaucauccgccuccgcccucgaucgacgcgcccccacacgcaaccaaccacaagccccaggcguagaagcguccggcgccggcgaagcccgcgccuccaccggcucguccgacuccucaccaggaggucacggcacccaaguaaaugucaccuguaucgugaacguuuguuccuccucagaucacagcucccaauguucuucccaagccuccuccacaaugggcgacaccgauuccagccccucagaaucccccaaagacgaacaagucccauucucaaaagaagagugugccuuccgaucccagcucgaaacaccagaaacccuacucgguucaaccgaagaaaaaccccucccccucggcgucccagacgcaggcaugaaacccuccuaa

SEQ ID NO: 5897 - RNA, 699 nt, Artificial Sequence
  derived and/or modified CDS sequence (opt11) from Homo sapiens__NP_001165094.1__HsVEGFA
augaacuuccuccuaagcuggguccacuggucccucgcccuacuccucuaccuacaccacgccaaauggucccaagccgcacccauggccgaaggcggcggccaaaaccaccacgaagucgucaaauucauggacgucuaccaacgcucauacugccaccccaucgaaacccucgucgacaucuuccaagaauaccccgacgaaauagaauacaucuucaaacccucaugcgucccccucaugcgcugcggcggcugcugcaacgacgaaggacucgaaugcguacccaccgaagaaucaaacaucacaaugcaaaucaugcgcaucaaaccccaccaaggccaacacaucggcgaaauguccuuccuccaacacaacaaaugcgaaugccgccccaaaaaagaccgagcacgacaagaaaaaaaauccguccgaggcaaaggcaaaggccaaaaacgaaaaagaaaaaaaucccgcuacaaauccugguccguauacgucggcgcccgaugcugccucaugccauggucccuccccggcccccacccaugcggccccugcuccgaacgccgcaaacaccucuucguccaagacccccaaaccugcaaaugcuccugcaaaaacaccgacuccagaugcaaagcccgccaacucgaacucaacgaacgcaccugucgcugcgacaaaccccgacgcuaa

SEQ ID NO: 5898 - RNA, 624 nt, Artificial Sequence
  derived and/or modified CDS sequence (opt11) from Homo sapiens__NP_003368.1__HsVEGFB
auguccccccuccuccgccgccuccuccucgcagcccuacuccaacuagcccccgcacaagcccccgucucccaacccgacgcccccggccaccaacgcaaaguagucuccuggauagacgucuacacccgcgccaccugucaaccccgcgaagucguagucccccucacagucgaacucaugggcacagucgccaaacaacucguacccucaugcgucaccguccaaagaugcggcggcugcugccccgacgacggccucgaaugcguccccaccggccaacaccaaguccgcaugcaaauacucaugauccgauacccaucaucccaacuaggagaaaugucacucgaagaacacucucaaugcgaaugcagacccaaaaaaaaagacucagccguaaaaccagaccgcgccgcaacaccccaccaccgcccccaaccacgaucaguccccggcugggacuccgcccccggcgcccccucccccgccgacaucacccaccccacccccgcccccggcccauccgcccacgccgcccccuccaccaccucugcccuaacccccggccccgccgccgccgccgcagacgccgccgccucauccgucgccaaaggcggcgccuaa

SEQ ID NO: 5899 - RNA, 1408 nt, Artificial Sequence
  mRNA product Design1 comprising derived and/or modified sequence from Homo sapiens__NP_001191.1__HsBMP2 (opt11)
gggagaaagcuuaccauggucgccggcacccguugccuccuugcccuccuccuaccccaaguccuacuaggcggagcagccggccucguccccgaacucggccgccgcaaauucgccgccgccucauccggacgccccuccucacaacccagcgacgaaguacucucagaauuugaacuucgucuacucuccauguucggccucaaacaacgacccacucccucccgcgacgcagucguccccccuuacaugcuagaccuuuaccgccgccacuccggccaacccggaucacccgcccccgaccaucgccucgaaagagccgccucccgagccaauaccguccgcucauuccaccacgaagaaucacucgaagaacuacccgaaaccagcggaaaaacaacacgcagauucuucuucaaccucuccagcauccccaccgaagaauuuaucaccuccgccgaacuacaaguauucagagaacaaaugcaggacgcccucggcaacaacuccagcuuccaccaccgcaucaacauauacgaaauaaucaaacccgccacagcuaacuccaaguuccccgucacacgccuacucgacacccgccuagucaaccaaaaugccucccgcugggaauccuucgacgucacccccgccgucaugcgauggaccgcacaaggccacgccaaucacggcuucgucguagaaguugcacaccuagaagaaaaacaaggcgucuccaaacgccacguccgcaucuccagaucccuacaccaagacgaacacucauggucccaaauccgcccccuccuagucaccuucggacaugacggcaaaggacacccgcuccacaaacgcgaaaaacgccaagccaaacacaaacaacgcaaacgccucaaaucauccugcaaacgccacccacucuacguagacuucuccgacguaggauggaacgacuggauagucgcacccccaggcuaccacgcauucuacugccacggagaaugcccauucccacuugccgaccaccucaacuccaccaaccacgcuaucguacaaacacucgucaacuccgucaacucaaaaaucccaaaagcaugcugcguccccacagaacucucagccaucuccaugcucuaccucgacgaaaacgaaaaggucguccuaaaaaacuaccaagacauggucgucgaaggcugcggcugccgcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5900 - RNA, 1513 nt, Artificial Sequence
  mRNA product Design1 comprising derived and/or modified sequence from Homo sapiens__NP_001710.1__HsBMP7 (opt11)
gggagaaagcuuaccaugcacguccgaucacuacgcgccgcagccccacacuccuucguagcacucugggcaccccuauucuuacuccgcuccgcacuagccgacuucucccucgacaacgaaguccacucgagcuucauccaccgccgccuacggucccaagaaagacgcgaaaugcaacgcgaaauccucucaauucuaggacucccccaccgcccccgcccccaccuccaaggcaaacacaacucugcccccauguucaugcucgaccucuacaacgccauggcaguagaagaaggaggcggacccggcggccaaggcuucucauaccccuacaaagccguuuucucaacccaaggcccgccccucgcaucccuccaagacucacacuuccuaaccgacgccgacaugguaaugucauucgucaaccucguagaacaugacaaagaauuuuuccacccccgcuaucaccaccgcgaauuucgauucgaccucucgaaaauacccgaaggcgaagccgugaccgcagccgaauuucgcauauacaaagacuacauccgcgaacgcuucgacaacgaaacauuccgcaucuccgucuaccaagugcuccaagaacaccucggccgcgaaagcgaccucuuccuacuugacucccgcacacuuugggccucugaagaagguuggcucguauucgacauaacagccaccucaaaccacuggguagucaacccccgucacaaccuaggacuccagcuaucaguagaaacacucgacggccagagcaucaaccccaaacuugcgggacucaucggccgccacggaccacaaaacaagcagcccuucauggucgccuucuuuaaagccaccgaaguacauuucagauccauacgcuccaccggguccaaacaacgaucacaaaaccgauccaaaaccccaaaaaaccaagaagcucuacgaauggcaaacguagcugaaaacagcuccucagaccaacgccaagccugcaaaaaacacgaacucuacgucuccuuccgagaccucggcuggcaagacuggaucaucgccccagaaggcuacgcagcauacuacugcgaaggcgaaugcgccuucccccuuaacucuuacaugaacgccaccaaccacgcaaucguccagacccucguacacuucaucaaccccgaaacuguccccaaacccugcugcgcccccacccaauuaaacgcaaucuccguccucuacuucgacgacuccucgaacgucauacucaaaaaauaccgaaacauggucguccgcgccugcggcugccauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5901 - RNA, 517 nt, Artificial Sequence
  mRNA product Design1 comprising derived and/or modified sequence from Homo sapiens__NP_006264.2__HsCCL7 (opt11)
gggagaaagcuuaccaugaaagccuccgccgcccuccucugccuccuccucaccgccgccgccuucuccccccaaggccuagcccaacccgucggcaucaacaccuccaccaccuguugcuaccgauucaucaacaaaaaaauccccaaacaacgccucgaauccuaccgccgcaccaccuccucacacugcccccgcgaagccgucaucuucaaaaccaaacucgacaaagaaaucugcgccgaccccacccaaaaauggguccaagacuucaugaaacaccucgacaaaaaaacccaaacccccaaacucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5902 - RNA, 802 nt, Artificial Sequence
  mRNA product Design1 comprising derived and/or modified sequence from Homo sapiens__NP_002000.1__HsFGF7 (opt11)
gggagaaagcuuaccaugcacaaauggauccucaccuggauccuccccacccuccucuaccgcuccugcuuccacaucaucugccucgucggcaccaucucccucgccugcaacgacaugacccccgaacaaauggccacaaacgucaacugcuccucccccgaacgccacacccgcuccuacgacuacauggaaggcggcgacauccgcguccgccgacucuucugccgcacccaaugguaccuacgcaucgacaaacgcggcaaaguaaaaggcacccaagaaaugaaaaacaacuacaacaucauggaaauccgcacagucgccgucggcauagucgcaaucaaaggcgucgaauccgaauuuuaccucgccaugaacaaagaaggcaaacucuacgccaaaaaagaaugcaacgaagacugcaacuucaaagaacucauccucgaaaaccacuacaacaccuacgccuccgccaaauggacccacaacggcggcgaaauguucgucgcccucaaccaaaaaggcauccccguccgcggcaaaaaaaccaaaaaagaacaaaaaaccgcccacuuccuccccauggccaucaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5903 - RNA, 1321 nt, Artificial Sequence
  mRNA product Design1 comprising derived and/or modified sequence from Homo sapiens__P48741__HsHSPA7 (opt11)
gggagaaagcuuaccaugcaagccccccgcgaacuagccguaggcaucgaccucggcacaaccuacagcugugucggcguauuccaacaaggcagaguagaaauccuagccaacgaccaaggcaacagaacgaccccaucauacgucgcguucaccgacacagaaaggcuaguaggagacgcagcaaaaucccaagcagcccuaaacccgcacaacacuguauucgacgccaaacgccuaaucggacgaaaauucgcagacacaaccguccaaucagacaugaaacacuggccauuccaagucgucuccgaagguggaaaacccaaaguacgaguaugcuaccgaggggaagacaaaacauucuacccagaagaaauaagcucaaugguacuaagcaaaaugaaagaaaccgcggaagccuaccuaggccaaccaguaaaacacgccguaaucacggucccgaccuacuucagcaacucccagagacaggccaccaaagacgcaggagcaaucgcaggccuaaaaguacucccaaucauaaacgaagccacagccgcagcaauagccuacggccuggaccgaagaggagccggcaaacgaaacguacucauauucgaccuaggaggaggaacauucgacguauccguacucucgaucgacgccggggucuucgaaguaaaagcuaccgccggcgacacccaccuaggaggcgaagacuucgacaaccgccuagucaaccacuucauggaagaauuucgcagaaaacacggcaaagaccuaagcggaaacaaacgagcccucagacgacuccgaacagccugcgaacgagccaaacgcaccccaucaagcagcacccaggccacacuagaaaucgacucccuauucgaaggcguagacuucuacaaaagcaucaccagagccagauucgaagaacucugcagcgaccuauuccgaagcacccuagaacccguggaaaaagcccuccgcgacgccaaacuagacaaagcacaaauccacgacuucguacuaggcggcgggcuccacagccacccacaaggcgcagaagucgccgcaggccuacuccaacgacaaggcgcagaacaagaacaccagccauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5904 - RNA, 2392 nt, Artificial Sequence
  mRNA product Design1 comprising derived and/or modified sequence from Homo sapiens__NP_031381.2__HsHSP90AB1 (opt11)
gggagaaagcuuaccaugcccgaagaagugcaccacggggaagaggaagucgaaaccuucgccuuccaggccgagauagcccaacucaugagcuuaaucauaaacaccuucuacuccaacaaagaaaucuuccucagagaguugauaucaaacgcaagcgacgcccuggacaagauaagauacgaaagccuaacagacccaucaaaacuggacucaggaaaggaguuaaaaauagacaucaucccaaacccacaagaacgcacgcucacccucguggacaccggaauaggaaugacaaaagccgaccucauaaacaaucucggcacgauagccaagagcgggacaaaagccuucauggaggcccuacaagcaggagccgacauaagcaugaucggacaauucggcguaggcuucuacagcgcauaccucgucgccgaaaaggugguaguaaucacaaaacacaacgacgacgaacaauacgccugggaaagcagcgccggcgggagcuucacagucagagcagaccacggcgaaccuauaggacgcgggacuaaaguaauccuccaccuaaaggaagaccaaaccgaauacuuagaagaacgcagggucaaggaagucgucaaaaaacacagccaguucaucggcuaccccauaacccucuaccuggaaaaagagagggaaaaggaaauaagugacgacgaggccgaggaagaaaaaggagaaaaagaagaagaagacaaagacgacgaagaaaagcccaagaucgaagacguaggaagcgacgaagaagacgacucaggaaaggacaagaaaaaaaaaacgaaaaaaaucaaagagaaauacaucgaccaagaagaacugaacaaaacaaaaccaaucuggaccaggaaccccgaugacaucacacaagaagaauacggggaauuuuacaaaucgcuaacaaacgacugggaggaccaccucgcgguaaagcacuucagcguggaaggacaacucgaauuuagagcacuacuauucaucccaaggagagcgccauucgaccuguucgaaaacaagaaaaaaaaaaacaacauaaagcuauacguccgacgagucuucauaauggacucaugcgacgaacugaucccagaauaccuaaacuucauccggggcguaguagacuccgaagaccucccacucaacaucagccgagaaaugcuacaacagagcaagauacugaaagugaucagaaaaaacaucguaaaaaagugccuagaacuauucagcgaauuagcagaggauaaagaaaacuacaagaaauucuacgaagccuucagcaagaaccuaaaacugggcauacacgaagacagcaccaaucgaaggcgccuaagcgaacuacuaagauaccacacaagucagagcggcgacgagaugacgagccuauccgaauacguuagccggaugaaagaaacgcaaaagucaauauacuacaucaccggagagagcaaggaacaaguagcgaacucggcauucgucgaacgcgugcgaaagcgcggauucgaagucguauacaugacggagcccaucgacgaguacuguguacaacagcucaaagaauuugacggcaaaagccuagucucaguaaccaaagaaggacuagaauugcccgaagacgaagaagagaagaaaaaaauggaagaaucaaaagccaaauucgagaacuugugcaagcugaugaaagagauccuagacaaaaagguagaaaaggucacgaucucaaaccggcuggugagcucgcccugcugcaucgucacgagcacauacggcuggacagcaaacauggaacgaauaaugaaagcacaagcccucagagacaacucaaccaugggguacaugauggccaagaaacaccucgaaauaaaccccgaccacccuauaguagaaacgcucaggcaaaaggccgaagcagacaaaaacgacaaagccguaaaagaccucgugguccugcucuuugaaacagcccuacucucaagcggauuuucacuggaggacccacaaacccacagcaacagaaucuaccgaaugauuaagcucggacuggguauugacgaggacgaaguagccgcggaagaacccaacgcggcaguccccgacgaaaucccgccccuggaaggggacgaggacgcaucaagaauggaagaggucgacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5905 - RNA, 856 nt, Artificial Sequence
  mRNA product Design1 comprising derived and/or modified sequence from Homo sapiens__NP_000591.1__HsIL6 (opt11)
gggagaaagcuuaccaugaacuccuucuccaccuccgccuucggccccgucgccuucucccucggccuccuacucguacuccccgccgccuucccagcccccguccccccaggcgaagacuccaaagacgucgccgccccccaccgccaaccucucaccucauccgaacgcaucgacaaacaaauacgcuacauccucgacggcaucuccgcccuccgcaaagaaaccugcaacaaaucaaacaugugcgaauccucaaaagaagcccucgccgaaaacaaccuaaaccuccccaaaauggccgaaaaagacggcugcuuccaauccggcuucaacgaagaaacaugccucgucaaaauaaucaccggacuccucgaauuugaagucuaccucgaauaccuacaaaaccgcuucgaaucauccgaagaacaagcccgcgccguccaaaugucaaccaaaguccucauccaauuccuccaaaaaaaagccaaaaaccucgacgccaucacaacccccgaccccaccaccaacgccucccuacucaccaaacuccaagcccaaaaccaauggcuccaagacaugaccacccaccucauccuccgcuccuucaaagaauuucuccaauccucccuccgcgcccuccgacaaauguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5906 - RNA, 1633 nt, Artificial Sequence
  mRNA product Design1 comprising derived and/or modified sequence from Homo sapiens__NP_002418.1__HsMMP13 (opt11)
gggagaaagcuuaccaugcaccccggcguacucgcagccuuccuauuccuauccuggacccacugccgcgcauuaccccuccccucaggaggcgaugaagacgaccuuuccgaagaagaccugcaauucgccgaacgcuaccuccgauccuacuaccaccccaccaaccucgccggcauacucaaagaaaacgcagccucauccaugacagaacgccuccgcgaaaugcaauccuucuuuggccucgaagucaccggaaaacuugacgacaacacgcuagacgucaugaaaaaacccagaugcggaguccccgacgucggcgaauacaacgucuuccccagaacccuaaaauggucaaaaaugaaccucaccuacagaauagucaacuacaccccugacaugacccacuccgaaguagaaaaagccuucaaaaaagccuucaaagucuggucugacguuaccccccucaacuucacccgacuccacgacggcaucgccgacauaaugaucuccuucggaaucaaagaacacggcgacuucuaccccuucgacggaccaucaggccuacucgcccacgccuucccaccaggacccaacuacggaggcgacgcccacuucgaugacgacgaaaccuggaccuccuccuccaaaggcuacaaccucuuccuaguagccgcacacgaauuuggccacucacuaggacuagaccacuccaaagaccccggcgcucuuauguuccccaucuacaccuacacugggaaaucccacuucaugcuccccgacgacgacguacaaggcauccaaagccucuacggcccgggcgacgaagaucccaaccccaaacaccccaaaacaccagacaaaugcgaccccucacuaucacuagacgcaaucaccucccuccguggcgaaacuaugaucuucaaagaccgauucuucuggcgcuuacacccccaacaagucgacgccgaacucuuccuuaccaaaucauucuggcccgaacuccccaaccgcaucgacgccgccuacgaacaccccagccaugaccucaucuuuaucuuccgcgggagaaaauucugggcacuaaacggauacgacauacucgaaggcuacccaaaaaaaaucuccgaacuaggccucccaaaggaagucaaaaagaucuccgcagcaguacacuucgaagacaccggcaaaacccuccuauucucagguaaccaaguauggcgcuacgacgacaccaaccacaucauggacaaagacuacccccgccucaucgaagaagacuuccccggcauaggcgacaaagucgacgccgucuaugaaaaaaacggcuacauauacuucuuuaacggccccauccaauuugaauacuccauaugguccaaccgcaucguacgcguuaugccagccaacuccauccucuggugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5907 - RNA, 1312 nt, Artificial Sequence
  mRNA product Design1 comprising derived and/or modified sequence from Homo sapiens__NP_149126.1__HsPDGFD (opt11)
gggagaaagcuuaccaugcaccgccuaaucuucgucuacacccuaaucugcgccaacuucugcuccugccgagacaccuccgccaccccacaauccgccuccauaaaagcacuccggaaugccaacuuacgccgggacgaccuauaccgucgagacgaaacaauccaaguaaaaggaaacggcuacgugcaaucgccccgauucccaaacuccuacccacgcaaccuccuccucaccuggcgacuacacucccaagaaaacacucgcauccaacucgucuucgacaaccaguucggccuggaagaagccgaaaacgacaucugccgcuacgacuucgucgaagucgaagacauaucagaaaccuccaccaucauacgcggccgcuggugcggccacaaagagguacccccccgcaucaaaucccgcacaaaccaaaucaaaauaaccuucaaaucagacgacuacuucguagcuaaacccggauucaaaaucuacuacucccuccuagaagacuuccaacccgccgcagcauccgagaccaacugggaauccguaaccuccuccauauccggcguauccuacaacagccccuccgucacagaccccacccuuauagccgacgcccucgacaaaaaaaucgccgaauuugacaccgucgaagaucuccuaaaauacuucaaccccgaaucauggcaagaagaccucgaaaacauguaccuagacaccccacgauaccgcggacgcucauaccacgaccgaaaauccaaagucgaccucgaccgacucaacgacgacgccaaacgcuacagcugcacaccacgcaacuacuccgucaacauccgcgaagaacuaaaacucgccaacguagucuucuucccccgcugccuucucguccaaagaugcggcggcaacugcggcuguggaaccguaaacuggcgcagcugcaccuguaacucaggcaaaaccgucaaaaaauaccacgaaguccuccaauucgaaccaggccacaucaaacgccgcggccgagccaaaacaauggcccucgucgacauccagcucgaccaccacgaacgcugcgacugcauaugcuccagccgccccccucgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5908 - RNA, 895 nt, Artificial Sequence
  mRNA product Design1 comprising derived and/or modified sequence from Homo sapiens__NP_003946.3__HsSOCS3 (opt11)
gggagaaagcuuaccauggucacccacuccaaauucccugccgcaggcaugucccgaccccucgacaccucccuccgacucaaaaccuucuccucaaaguccgaauaccaacucgucgucaacgccguccguaaacuccaagaauccggcuucuacugguccgccgucaccgguggugaagcaaaccuccuccucuccgcagaacccgccggcaccuuccucauccgcgacuccucagaccaacgccacuucuucacccucucagucaaaacccaauccggcaccaaaaaccuccgcauccaaugcgaaggcggcuccuucucccuccaauccgacccacgcuccacacaaccugucccacgcuucgacugcguccucaaacucguccaccacuacaugccaccccccggcgcccccuccuucccauccccccccaccgaacccuccucagaaguccccgaacaacccucagcccaaccccuccccggcucccccccccgccgcgcauacuacaucuacuccggcggcgaaaaaaucccacucguacucucccgcccccucuccuccaacgucgccacccuacaacaccucugccgcaaaaccgucaacggccaccucgacuccuacgaaaaagucacccaacuacccggccccauccgcgaauuucucgaccaauacgaugcaccccuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5909 - RNA, 700 nt, Artificial Sequence
  mRNA product Design1 comprising derived and/or modified sequence from Homo sapiens__NP_003227.1__HsTGFA (opt11)
gggagaaagcuuaccaugguccccuccgccggccaacucgcccuauucgcccucggaaucguccucgcagccugccaagcccucgaaaacuccaccuccccccucuccgccgacccccccgucgccgccgccgucgucucccacuucaacgacugccccgacucccacacccaauucugcuuccacggcaccugucgcuuccucguccaagaagacaaacccgccugcgucugccacuccggcuacgucggcgcccgcugcgaacacgccgaccuccucgccgucgucgccgccucccaaaaaaaacaagccaucaccgcccucgucgucgucuccaucgucgcccucgccguccucaucaucaccuguguccuaauccacugcugccaaguccgcaaacacugcgaauggugccgcgcccucaucugccgccacgaaaaacccuccgcccuccucaaaggccgcaccgccugcugccacuccgaaacagucguuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5910 - RNA, 1462 nt, Artificial Sequence
  mRNA product Design1 comprising derived and/or modified sequence from Homo sapiens__NP_003229.1__HsTGFB2 (opt11)
gggagaaagcuuaccaugcacuacugcguccucuccgccuuccucauauuacaccucgucaccguugcccuaucccucucgacuugcuccacccucgacauggaccaauucaugcgcaaaagaaucgaagcaauccgaggccaaauccucucaaaacucaaacuuacaucccccccugaagacuauccagaacccgaggaaguccccccugaagucauauccauauacaacagcacccgcgaccuacuccaagaaaaagccucgcgacgagccgcagccugcgaacgcgaacgcagcgacgaagaauacuacgccaaggaagucuacaaaaucgacaugccgcccuucuucccaucagagaaugcuaucccccccaccuucuaccgaccauacuuccgcaucguccgcuucgacgucuccgcaauggaaaaaaacgccuccaaccucgucaaagccgaauuucgcgucuuccgccugcaaaaccccaaagcccgcguucccgaacaacgcaucgaacucuaccaaauacucaaauccaaagaccucaccucucccacccaacguuacaucgacucuaaaguagucaaaacacgcgccgaaggcgaauggcucuccuucgacguaaccgacgccguacacgaauggcuccaccacaaagacagaaaccucggauucaaaaucucccuacacugccccugcugcacuuucguccccuccaacaacuacauaauucccaacaaauccgaagaacuugaagcccgcuucgccggcaucgacggaaccucgaccuacacuucaggcgaccagaaaaccauuaaauccacccgcaaaaaaaacucgggcaaaacaccccaccuccuacucaugcuccucccauccuaccggcuagaaucccaacaaaccaaccgacgcaaaaaacgagcccucgacgcagccuacugcuuccguaacguccaagacaauugcugccuacgcccacucuacaucgauuucaaacgugaccucggauggaaauggauccaugaacccaaaggcuacaacgccaacuucugcgcaggcgcaugccccuaccucuggagcuccgacacccaacacucccgcguccuaagccuuuacaacaccaucaaccccgaagccucagccucccccugcugcgucucccaagaccucgaaccacuaacaauccucuacuacaucggcaaaacccccaaaauagaacaacucuccaacaugaucgucaaauccugcaaaugcuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5911 - RNA, 1603 nt, Artificial Sequence
  mRNA product Design1 comprising derived and/or modified sequence from Homo sapiens__NP_001057.1__HsTNFRSF1B (opt11)
gggagaaagcuuaccauggcaccagucgcagucugggccgcccucgccguaggccuugaacucugggcagccgcccacgcccucccagcacaagucgcauucacucccuacgcacccgaacccggcuccaccugucgccuacgcgaauacuaugaccaaacagcacaaaugugcugcuccaaaugcucucccggccaacacgcuaaaguauucugcacaaaaaccucugacaccguaugcgacucaugcgaagacuccacauauacccaacucuggaacuggguccccgaaugccucuccugcggcucccgcugcagcucagaccaaguagaaacccaagcaugcacccgcgagcaaaaccgcaucugcacaugccgccccggcugguacugcgcucucuccaaacaagaaggcugcagacuuugugcaccucugaggaaaugccgaccaggcuuugguguagcaagacccgguaccgaaaccucagacgucgucugcaaaccgugugcacccggcaccuucucaaacaccaccuccucuaccgacaucugccgaccacaucaaaucugcaacguagucgccaucccaggcaacgccuccauggacgccguaugcaccucgaccucccccacccgcuccauggcccccggcgccguacaccuaccccaacccgucuccacccgaucccagcacacccaacccaccccagaacccagcaccgccccgucaaccucauuccuacucccaaugggccccuccccacccgcagaaggcuccacaggcgauuucgcccuccccguaggacuaauaguuggcgucaccgcccuaggccuccuuaucaucggcguagucaacugcgucaucaugacccaagucaaaaaaaaaccccucugccuccaacgcgaagccaaagucccacaccucccagccgacaaagcccgcggaacccaaggccccgaacaacaacaccuccucaucaccgcccccucaucaagcuccuccucacucgaaucauccgccuccgcccucgaucgacgcgcccccacacgcaaccaaccacaagccccaggcguagaagcguccggcgccggcgaagcccgcgccuccaccggcucguccgacuccucaccaggaggucacggcacccaaguaaaugucaccuguaucgugaacguuuguuccuccucagaucacagcucccaauguucuucccaagccuccuccacaaugggcgacaccgauuccagccccucagaaucccccaaagacgaacaagucccauucucaaaagaagagugugccuuccgaucccagcucgaaacaccagaaacccuacucgguucaaccgaagaaaaaccccucccccucggcgucccagacgcaggcaugaaacccuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5912 - RNA, 916 nt, Artificial Sequence
  mRNA product Design1 comprising derived and/or modified sequence from Homo sapiens__NP_001165094.1__HsVEGFA (opt11)
gggagaaagcuuaccaugaacuuccuccuaagcuggguccacuggucccucgcccuacuccucuaccuacaccacgccaaauggucccaagccgcacccauggccgaaggcggcggccaaaaccaccacgaagucgucaaauucauggacgucuaccaacgcucauacugccaccccaucgaaacccucgucgacaucuuccaagaauaccccgacgaaauagaauacaucuucaaacccucaugcgucccccucaugcgcugcggcggcugcugcaacgacgaaggacucgaaugcguacccaccgaagaaucaaacaucacaaugcaaaucaugcgcaucaaaccccaccaaggccaacacaucggcgaaauguccuuccuccaacacaacaaaugcgaaugccgccccaaaaaagaccgagcacgacaagaaaaaaaauccguccgaggcaaaggcaaaggccaaaaacgaaaaagaaaaaaaucccgcuacaaauccugguccguauacgucggcgcccgaugcugccucaugccauggucccuccccggcccccacccaugcggccccugcuccgaacgccgcaaacaccucuucguccaagacccccaaaccugcaaaugcuccugcaaaaacaccgacuccagaugcaaagcccgccaacucgaacucaacgaacgcaccugucgcugcgacaaaccccgacgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5913 - RNA, 841 nt, Artificial Sequence
  mRNA product Design1 comprising derived and/or modified sequence from Homo sapiens__NP_003368.1__HsVEGFB (opt11)
gggagaaagcuuaccauguccccccuccuccgccgccuccuccucgcagcccuacuccaacuagcccccgcacaagcccccgucucccaacccgacgcccccggccaccaacgcaaaguagucuccuggauagacgucuacacccgcgccaccugucaaccccgcgaagucguagucccccucacagucgaacucaugggcacagucgccaaacaacucguacccucaugcgucaccguccaaagaugcggcggcugcugccccgacgacggccucgaaugcguccccaccggccaacaccaaguccgcaugcaaauacucaugauccgauacccaucaucccaacuaggagaaaugucacucgaagaacacucucaaugcgaaugcagacccaaaaaaaaagacucagccguaaaaccagaccgcgccgcaacaccccaccaccgcccccaaccacgaucaguccccggcugggacuccgcccccggcgcccccucccccgccgacaucacccaccccacccccgcccccggcccauccgcccacgccgcccccuccaccaccucugcccuaacccccggccccgccgccgccgccgcagacgccgccgccucauccgucgccaaaggcggcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5914 - RNA, 1573 nt, Artificial Sequence
  mRNA product Design2 comprising derived and/or modified sequence from Homo sapiens__NP_001191.1__HsBMP2 (opt11)
ggggcgcugccuacggagguggcagccaucuccuucucggcaucaagcuuaccauggucgccggcacccguugccuccuugcccuccuccuaccccaaguccuacuaggcggagcagccggccucguccccgaacucggccgccgcaaauucgccgccgccucauccggacgccccuccucacaacccagcgacgaaguacucucagaauuugaacuucgucuacucuccauguucggccucaaacaacgacccacucccucccgcgacgcagucguccccccuuacaugcuagaccuuuaccgccgccacuccggccaacccggaucacccgcccccgaccaucgccucgaaagagccgccucccgagccaauaccguccgcucauuccaccacgaagaaucacucgaagaacuacccgaaaccagcggaaaaacaacacgcagauucuucuucaaccucuccagcauccccaccgaagaauuuaucaccuccgccgaacuacaaguauucagagaacaaaugcaggacgcccucggcaacaacuccagcuuccaccaccgcaucaacauauacgaaauaaucaaacccgccacagcuaacuccaaguuccccgucacacgccuacucgacacccgccuagucaaccaaaaugccucccgcugggaauccuucgacgucacccccgccgucaugcgauggaccgcacaaggccacgccaaucacggcuucgucguagaaguugcacaccuagaagaaaaacaaggcgucuccaaacgccacguccgcaucuccagaucccuacaccaagacgaacacucauggucccaaauccgcccccuccuagucaccuucggacaugacggcaaaggacacccgcuccacaaacgcgaaaaacgccaagccaaacacaaacaacgcaaacgccucaaaucauccugcaaacgccacccacucuacguagacuucuccgacguaggauggaacgacuggauagucgcacccccaggcuaccacgcauucuacugccacggagaaugcccauucccacuugccgaccaccucaacuccaccaaccacgcuaucguacaaacacucgucaacuccgucaacucaaaaaucccaaaagcaugcugcguccccacagaacucucagccaucuccaugcucuaccucgacgaaaacgaaaaggucguccuaaaaaacuaccaagacauggucgucgaaggcugcggcugccgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5915 - RNA, 1678 nt, Artificial Sequence
  mRNA product Design2 comprising derived and/or modified sequence from Homo sapiens__NP_001710.1__HsBMP7 (opt11)
ggggcgcugccuacggagguggcagccaucuccuucucggcaucaagcuuaccaugcacguccgaucacuacgcgccgcagccccacacuccuucguagcacucugggcaccccuauucuuacuccgcuccgcacuagccgacuucucccucgacaacgaaguccacucgagcuucauccaccgccgccuacggucccaagaaagacgcgaaaugcaacgcgaaauccucucaauucuaggacucccccaccgcccccgcccccaccuccaaggcaaacacaacucugcccccauguucaugcucgaccucuacaacgccauggcaguagaagaaggaggcggacccggcggccaaggcuucucauaccccuacaaagccguuuucucaacccaaggcccgccccucgcaucccuccaagacucacacuuccuaaccgacgccgacaugguaaugucauucgucaaccucguagaacaugacaaagaauuuuuccacccccgcuaucaccaccgcgaauuucgauucgaccucucgaaaauacccgaaggcgaagccgugaccgcagccgaauuucgcauauacaaagacuacauccgcgaacgcuucgacaacgaaacauuccgcaucuccgucuaccaagugcuccaagaacaccucggccgcgaaagcgaccucuuccuacuugacucccgcacacuuugggccucugaagaagguuggcucguauucgacauaacagccaccucaaaccacuggguagucaacccccgucacaaccuaggacuccagcuaucaguagaaacacucgacggccagagcaucaaccccaaacuugcgggacucaucggccgccacggaccacaaaacaagcagcccuucauggucgccuucuuuaaagccaccgaaguacauuucagauccauacgcuccaccggguccaaacaacgaucacaaaaccgauccaaaaccccaaaaaaccaagaagcucuacgaauggcaaacguagcugaaaacagcuccucagaccaacgccaagccugcaaaaaacacgaacucuacgucuccuuccgagaccucggcuggcaagacuggaucaucgccccagaaggcuacgcagcauacuacugcgaaggcgaaugcgccuucccccuuaacucuuacaugaacgccaccaaccacgcaaucguccagacccucguacacuucaucaaccccgaaacuguccccaaacccugcugcgcccccacccaauuaaacgcaaucuccguccucuacuucgacgacuccucgaacgucauacucaaaaaauaccgaaacauggucguccgcgccugcggcugccauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5916 - RNA, 682 nt, Artificial Sequence
  mRNA product Design2 comprising derived and/or modified sequence from Homo sapiens__NP_006264.2__HsCCL7 (opt11)
ggggcgcugccuacggagguggcagccaucuccuucucggcaucaagcuuaccaugaaagccuccgccgcccuccucugccuccuccucaccgccgccgccuucuccccccaaggccuagcccaacccgucggcaucaacaccuccaccaccuguugcuaccgauucaucaacaaaaaaauccccaaacaacgccucgaauccuaccgccgcaccaccuccucacacugcccccgcgaagccgucaucuucaaaaccaaacucgacaaagaaaucugcgccgaccccacccaaaaauggguccaagacuucaugaaacaccucgacaaaaaaacccaaacccccaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5917 - RNA, 967 nt, Artificial Sequence
  mRNA product Design2 comprising derived and/or modified sequence from Homo sapiens__NP_002000.1__HsFGF7 (opt11)
ggggcgcugccuacggagguggcagccaucuccuucucggcaucaagcuuaccaugcacaaauggauccucaccuggauccuccccacccuccucuaccgcuccugcuuccacaucaucugccucgucggcaccaucucccucgccugcaacgacaugacccccgaacaaauggccacaaacgucaacugcuccucccccgaacgccacacccgcuccuacgacuacauggaaggcggcgacauccgcguccgccgacucuucugccgcacccaaugguaccuacgcaucgacaaacgcggcaaaguaaaaggcacccaagaaaugaaaaacaacuacaacaucauggaaauccgcacagucgccgucggcauagucgcaaucaaaggcgucgaauccgaauuuuaccucgccaugaacaaagaaggcaaacucuacgccaaaaaagaaugcaacgaagacugcaacuucaaagaacucauccucgaaaaccacuacaacaccuacgccuccgccaaauggacccacaacggcggcgaaauguucgucgcccucaaccaaaaaggcauccccguccgcggcaaaaaaaccaaaaaagaacaaaaaaccgcccacuuccuccccauggccaucaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5918 - RNA, 1486 nt, Artificial Sequence
  mRNA product Design2 comprising derived and/or modified sequence from Homo sapiens__P48741__HsHSPA7 (opt11)
ggggcgcugccuacggagguggcagccaucuccuucucggcaucaagcuuaccaugcaagccccccgcgaacuagccguaggcaucgaccucggcacaaccuacagcugugucggcguauuccaacaaggcagaguagaaauccuagccaacgaccaaggcaacagaacgaccccaucauacgucgcguucaccgacacagaaaggcuaguaggagacgcagcaaaaucccaagcagcccuaaacccgcacaacacuguauucgacgccaaacgccuaaucggacgaaaauucgcagacacaaccguccaaucagacaugaaacacuggccauuccaagucgucuccgaagguggaaaacccaaaguacgaguaugcuaccgaggggaagacaaaacauucuacccagaagaaauaagcucaaugguacuaagcaaaaugaaagaaaccgcggaagccuaccuaggccaaccaguaaaacacgccguaaucacggucccgaccuacuucagcaacucccagagacaggccaccaaagacgcaggagcaaucgcaggccuaaaaguacucccaaucauaaacgaagccacagccgcagcaauagccuacggccuggaccgaagaggagccggcaaacgaaacguacucauauucgaccuaggaggaggaacauucgacguauccguacucucgaucgacgccggggucuucgaaguaaaagcuaccgccggcgacacccaccuaggaggcgaagacuucgacaaccgccuagucaaccacuucauggaagaauuucgcagaaaacacggcaaagaccuaagcggaaacaaacgagcccucagacgacuccgaacagccugcgaacgagccaaacgcaccccaucaagcagcacccaggccacacuagaaaucgacucccuauucgaaggcguagacuucuacaaaagcaucaccagagccagauucgaagaacucugcagcgaccuauuccgaagcacccuagaacccguggaaaaagcccuccgcgacgccaaacuagacaaagcacaaauccacgacuucguacuaggcggcgggcuccacagccacccacaaggcgcagaagucgccgcaggccuacuccaacgacaaggcgcagaacaagaacaccagccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5919 - RNA, 2557 nt, Artificial Sequence
  mRNA product Design2 comprising derived and/or modified sequence from Homo sapiens__NP_031381.2__HsHSP90AB1 (opt11)
ggggcgcugccuacggagguggcagccaucuccuucucggcaucaagcuuaccaugcccgaagaagugcaccacggggaagaggaagucgaaaccuucgccuuccaggccgagauagcccaacucaugagcuuaaucauaaacaccuucuacuccaacaaagaaaucuuccucagagaguugauaucaaacgcaagcgacgcccuggacaagauaagauacgaaagccuaacagacccaucaaaacuggacucaggaaaggaguuaaaaauagacaucaucccaaacccacaagaacgcacgcucacccucguggacaccggaauaggaaugacaaaagccgaccucauaaacaaucucggcacgauagccaagagcgggacaaaagccuucauggaggcccuacaagcaggagccgacauaagcaugaucggacaauucggcguaggcuucuacagcgcauaccucgucgccgaaaaggugguaguaaucacaaaacacaacgacgacgaacaauacgccugggaaagcagcgccggcgggagcuucacagucagagcagaccacggcgaaccuauaggacgcgggacuaaaguaauccuccaccuaaaggaagaccaaaccgaauacuuagaagaacgcagggucaaggaagucgucaaaaaacacagccaguucaucggcuaccccauaacccucuaccuggaaaaagagagggaaaaggaaauaagugacgacgaggccgaggaagaaaaaggagaaaaagaagaagaagacaaagacgacgaagaaaagcccaagaucgaagacguaggaagcgacgaagaagacgacucaggaaaggacaagaaaaaaaaaacgaaaaaaaucaaagagaaauacaucgaccaagaagaacugaacaaaacaaaaccaaucuggaccaggaaccccgaugacaucacacaagaagaauacggggaauuuuacaaaucgcuaacaaacgacugggaggaccaccucgcgguaaagcacuucagcguggaaggacaacucgaauuuagagcacuacuauucaucccaaggagagcgccauucgaccuguucgaaaacaagaaaaaaaaaaacaacauaaagcuauacguccgacgagucuucauaauggacucaugcgacgaacugaucccagaauaccuaaacuucauccggggcguaguagacuccgaagaccucccacucaacaucagccgagaaaugcuacaacagagcaagauacugaaagugaucagaaaaaacaucguaaaaaagugccuagaacuauucagcgaauuagcagaggauaaagaaaacuacaagaaauucuacgaagccuucagcaagaaccuaaaacugggcauacacgaagacagcaccaaucgaaggcgccuaagcgaacuacuaagauaccacacaagucagagcggcgacgagaugacgagccuauccgaauacguuagccggaugaaagaaacgcaaaagucaauauacuacaucaccggagagagcaaggaacaaguagcgaacucggcauucgucgaacgcgugcgaaagcgcggauucgaagucguauacaugacggagcccaucgacgaguacuguguacaacagcucaaagaauuugacggcaaaagccuagucucaguaaccaaagaaggacuagaauugcccgaagacgaagaagagaagaaaaaaauggaagaaucaaaagccaaauucgagaacuugugcaagcugaugaaagagauccuagacaaaaagguagaaaaggucacgaucucaaaccggcuggugagcucgcccugcugcaucgucacgagcacauacggcuggacagcaaacauggaacgaauaaugaaagcacaagcccucagagacaacucaaccaugggguacaugauggccaagaaacaccucgaaauaaaccccgaccacccuauaguagaaacgcucaggcaaaaggccgaagcagacaaaaacgacaaagccguaaaagaccucgugguccugcucuuugaaacagcccuacucucaagcggauuuucacuggaggacccacaaacccacagcaacagaaucuaccgaaugauuaagcucggacuggguauugacgaggacgaaguagccgcggaagaacccaacgcggcaguccccgacgaaaucccgccccuggaaggggacgaggacgcaucaagaauggaagaggucgacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5920 - RNA, 1021 nt, Artificial Sequence
  mRNA product Design2 comprising derived and/or modified sequence from Homo sapiens__NP_000591.1__HsIL6 (opt11)
ggggcgcugccuacggagguggcagccaucuccuucucggcaucaagcuuaccaugaacuccuucuccaccuccgccuucggccccgucgccuucucccucggccuccuacucguacuccccgccgccuucccagcccccguccccccaggcgaagacuccaaagacgucgccgccccccaccgccaaccucucaccucauccgaacgcaucgacaaacaaauacgcuacauccucgacggcaucuccgcccuccgcaaagaaaccugcaacaaaucaaacaugugcgaauccucaaaagaagcccucgccgaaaacaaccuaaaccuccccaaaauggccgaaaaagacggcugcuuccaauccggcuucaacgaagaaacaugccucgucaaaauaaucaccggacuccucgaauuugaagucuaccucgaauaccuacaaaaccgcuucgaaucauccgaagaacaagcccgcgccguccaaaugucaaccaaaguccucauccaauuccuccaaaaaaaagccaaaaaccucgacgccaucacaacccccgaccccaccaccaacgccucccuacucaccaaacuccaagcccaaaaccaauggcuccaagacaugaccacccaccucauccuccgcuccuucaaagaauuucuccaauccucccuccgcgcccuccgacaaauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5921 - RNA, 1798 nt, Artificial Sequence
  mRNA product Design2 comprising derived and/or modified sequence from Homo sapiens__NP_002418.1__HsMMP13 (opt11)
ggggcgcugccuacggagguggcagccaucuccuucucggcaucaagcuuaccaugcaccccggcguacucgcagccuuccuauuccuauccuggacccacugccgcgcauuaccccuccccucaggaggcgaugaagacgaccuuuccgaagaagaccugcaauucgccgaacgcuaccuccgauccuacuaccaccccaccaaccucgccggcauacucaaagaaaacgcagccucauccaugacagaacgccuccgcgaaaugcaauccuucuuuggccucgaagucaccggaaaacuugacgacaacacgcuagacgucaugaaaaaacccagaugcggaguccccgacgucggcgaauacaacgucuuccccagaacccuaaaauggucaaaaaugaaccucaccuacagaauagucaacuacaccccugacaugacccacuccgaaguagaaaaagccuucaaaaaagccuucaaagucuggucugacguuaccccccucaacuucacccgacuccacgacggcaucgccgacauaaugaucuccuucggaaucaaagaacacggcgacuucuaccccuucgacggaccaucaggccuacucgcccacgccuucccaccaggacccaacuacggaggcgacgcccacuucgaugacgacgaaaccuggaccuccuccuccaaaggcuacaaccucuuccuaguagccgcacacgaauuuggccacucacuaggacuagaccacuccaaagaccccggcgcucuuauguuccccaucuacaccuacacugggaaaucccacuucaugcuccccgacgacgacguacaaggcauccaaagccucuacggcccgggcgacgaagaucccaaccccaaacaccccaaaacaccagacaaaugcgaccccucacuaucacuagacgcaaucaccucccuccguggcgaaacuaugaucuucaaagaccgauucuucuggcgcuuacacccccaacaagucgacgccgaacucuuccuuaccaaaucauucuggcccgaacuccccaaccgcaucgacgccgccuacgaacaccccagccaugaccucaucuuuaucuuccgcgggagaaaauucugggcacuaaacggauacgacauacucgaaggcuacccaaaaaaaaucuccgaacuaggccucccaaaggaagucaaaaagaucuccgcagcaguacacuucgaagacaccggcaaaacccuccuauucucagguaaccaaguauggcgcuacgacgacaccaaccacaucauggacaaagacuacccccgccucaucgaagaagacuuccccggcauaggcgacaaagucgacgccgucuaugaaaaaaacggcuacauauacuucuuuaacggccccauccaauuugaauacuccauaugguccaaccgcaucguacgcguuaugccagccaacuccauccucuggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5922 - RNA, 1477 nt, Artificial Sequence
  mRNA product Design2 comprising derived and/or modified sequence from Homo sapiens__NP_149126.1__HsPDGFD (opt11)
ggggcgcugccuacggagguggcagccaucuccuucucggcaucaagcuuaccaugcaccgccuaaucuucgucuacacccuaaucugcgccaacuucugcuccugccgagacaccuccgccaccccacaauccgccuccauaaaagcacuccggaaugccaacuuacgccgggacgaccuauaccgucgagacgaaacaauccaaguaaaaggaaacggcuacgugcaaucgccccgauucccaaacuccuacccacgcaaccuccuccucaccuggcgacuacacucccaagaaaacacucgcauccaacucgucuucgacaaccaguucggccuggaagaagccgaaaacgacaucugccgcuacgacuucgucgaagucgaagacauaucagaaaccuccaccaucauacgcggccgcuggugcggccacaaagagguacccccccgcaucaaaucccgcacaaaccaaaucaaaauaaccuucaaaucagacgacuacuucguagcuaaacccggauucaaaaucuacuacucccuccuagaagacuuccaacccgccgcagcauccgagaccaacugggaauccguaaccuccuccauauccggcguauccuacaacagccccuccgucacagaccccacccuuauagccgacgcccucgacaaaaaaaucgccgaauuugacaccgucgaagaucuccuaaaauacuucaaccccgaaucauggcaagaagaccucgaaaacauguaccuagacaccccacgauaccgcggacgcucauaccacgaccgaaaauccaaagucgaccucgaccgacucaacgacgacgccaaacgcuacagcugcacaccacgcaacuacuccgucaacauccgcgaagaacuaaaacucgccaacguagucuucuucccccgcugccuucucguccaaagaugcggcggcaacugcggcuguggaaccguaaacuggcgcagcugcaccuguaacucaggcaaaaccgucaaaaaauaccacgaaguccuccaauucgaaccaggccacaucaaacgccgcggccgagccaaaacaauggcccucgucgacauccagcucgaccaccacgaacgcugcgacugcauaugcuccagccgccccccucgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5923 - RNA, 1060 nt, Artificial Sequence
  mRNA product Design2 comprising derived and/or modified sequence from Homo sapiens__NP_003946.3__HsSOCS3 (opt11)
ggggcgcugccuacggagguggcagccaucuccuucucggcaucaagcuuaccauggucacccacuccaaauucccugccgcaggcaugucccgaccccucgacaccucccuccgacucaaaaccuucuccucaaaguccgaauaccaacucgucgucaacgccguccguaaacuccaagaauccggcuucuacugguccgccgucaccgguggugaagcaaaccuccuccucuccgcagaacccgccggcaccuuccucauccgcgacuccucagaccaacgccacuucuucacccucucagucaaaacccaauccggcaccaaaaaccuccgcauccaaugcgaaggcggcuccuucucccuccaauccgacccacgcuccacacaaccugucccacgcuucgacugcguccucaaacucguccaccacuacaugccaccccccggcgcccccuccuucccauccccccccaccgaacccuccucagaaguccccgaacaacccucagcccaaccccuccccggcucccccccccgccgcgcauacuacaucuacuccggcggcgaaaaaaucccacucguacucucccgcccccucuccuccaacgucgccacccuacaacaccucugccgcaaaaccgucaacggccaccucgacuccuacgaaaaagucacccaacuacccggccccauccgcgaauuucucgaccaauacgaugcaccccuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5924 - RNA, 865 nt, Artificial Sequence
  mRNA product Design2 comprising derived and/or modified sequence from Homo sapiens__NP_003227.1__HsTGFA (opt11)
ggggcgcugccuacggagguggcagccaucuccuucucggcaucaagcuuaccaugguccccuccgccggccaacucgcccuauucgcccucggaaucguccucgcagccugccaagcccucgaaaacuccaccuccccccucuccgccgacccccccgucgccgccgccgucgucucccacuucaacgacugccccgacucccacacccaauucugcuuccacggcaccugucgcuuccucguccaagaagacaaacccgccugcgucugccacuccggcuacgucggcgcccgcugcgaacacgccgaccuccucgccgucgucgccgccucccaaaaaaaacaagccaucaccgcccucgucgucgucuccaucgucgcccucgccguccucaucaucaccuguguccuaauccacugcugccaaguccgcaaacacugcgaauggugccgcgcccucaucugccgccacgaaaaacccuccgcccuccucaaaggccgcaccgccugcugccacuccgaaacagucguuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5925 - RNA, 1627 nt, Artificial Sequence
  mRNA product Design2 comprising derived and/or modified sequence from Homo sapiens__NP_003229.1__HsTGFB2 (opt11)
ggggcgcugccuacggagguggcagccaucuccuucucggcaucaagcuuaccaugcacuacugcguccucuccgccuuccucauauuacaccucgucaccguugcccuaucccucucgacuugcuccacccucgacauggaccaauucaugcgcaaaagaaucgaagcaauccgaggccaaauccucucaaaacucaaacuuacaucccccccugaagacuauccagaacccgaggaaguccccccugaagucauauccauauacaacagcacccgcgaccuacuccaagaaaaagccucgcgacgagccgcagccugcgaacgcgaacgcagcgacgaagaauacuacgccaaggaagucuacaaaaucgacaugccgcccuucuucccaucagagaaugcuaucccccccaccuucuaccgaccauacuuccgcaucguccgcuucgacgucuccgcaauggaaaaaaacgccuccaaccucgucaaagccgaauuucgcgucuuccgccugcaaaaccccaaagcccgcguucccgaacaacgcaucgaacucuaccaaauacucaaauccaaagaccucaccucucccacccaacguuacaucgacucuaaaguagucaaaacacgcgccgaaggcgaauggcucuccuucgacguaaccgacgccguacacgaauggcuccaccacaaagacagaaaccucggauucaaaaucucccuacacugccccugcugcacuuucguccccuccaacaacuacauaauucccaacaaauccgaagaacuugaagcccgcuucgccggcaucgacggaaccucgaccuacacuucaggcgaccagaaaaccauuaaauccacccgcaaaaaaaacucgggcaaaacaccccaccuccuacucaugcuccucccauccuaccggcuagaaucccaacaaaccaaccgacgcaaaaaacgagcccucgacgcagccuacugcuuccguaacguccaagacaauugcugccuacgcccacucuacaucgauuucaaacgugaccucggauggaaauggauccaugaacccaaaggcuacaacgccaacuucugcgcaggcgcaugccccuaccucuggagcuccgacacccaacacucccgcguccuaagccuuuacaacaccaucaaccccgaagccucagccucccccugcugcgucucccaagaccucgaaccacuaacaauccucuacuacaucggcaaaacccccaaaauagaacaacucuccaacaugaucgucaaauccugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5926 - RNA, 1768 nt, Artificial Sequence
  mRNA product Design2 comprising derived and/or modified sequence from Homo sapiens__NP_001057.1__HsTNFRSF1B (opt11)
ggggcgcugccuacggagguggcagccaucuccuucucggcaucaagcuuaccauggcaccagucgcagucugggccgcccucgccguaggccuugaacucugggcagccgcccacgcccucccagcacaagucgcauucacucccuacgcacccgaacccggcuccaccugucgccuacgcgaauacuaugaccaaacagcacaaaugugcugcuccaaaugcucucccggccaacacgcuaaaguauucugcacaaaaaccucugacaccguaugcgacucaugcgaagacuccacauauacccaacucuggaacuggguccccgaaugccucuccugcggcucccgcugcagcucagaccaaguagaaacccaagcaugcacccgcgagcaaaaccgcaucugcacaugccgccccggcugguacugcgcucucuccaaacaagaaggcugcagacuuugugcaccucugaggaaaugccgaccaggcuuugguguagcaagacccgguaccgaaaccucagacgucgucugcaaaccgugugcacccggcaccuucucaaacaccaccuccucuaccgacaucugccgaccacaucaaaucugcaacguagucgccaucccaggcaacgccuccauggacgccguaugcaccucgaccucccccacccgcuccauggcccccggcgccguacaccuaccccaacccgucuccacccgaucccagcacacccaacccaccccagaacccagcaccgccccgucaaccucauuccuacucccaaugggccccuccccacccgcagaaggcuccacaggcgauuucgcccuccccguaggacuaauaguuggcgucaccgcccuaggccuccuuaucaucggcguagucaacugcgucaucaugacccaagucaaaaaaaaaccccucugccuccaacgcgaagccaaagucccacaccucccagccgacaaagcccgcggaacccaaggccccgaacaacaacaccuccucaucaccgcccccucaucaagcuccuccucacucgaaucauccgccuccgcccucgaucgacgcgcccccacacgcaaccaaccacaagccccaggcguagaagcguccggcgccggcgaagcccgcgccuccaccggcucguccgacuccucaccaggaggucacggcacccaaguaaaugucaccuguaucgugaacguuuguuccuccucagaucacagcucccaauguucuucccaagccuccuccacaaugggcgacaccgauuccagccccucagaaucccccaaagacgaacaagucccauucucaaaagaagagugugccuuccgaucccagcucgaaacaccagaaacccuacucgguucaaccgaagaaaaaccccucccccucggcgucccagacgcaggcaugaaacccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5927 - RNA, 1081 nt, Artificial Sequence
  mRNA product Design2 comprising derived and/or modified sequence from Homo sapiens__NP_001165094.1__HsVEGFA (opt11)
ggggcgcugccuacggagguggcagccaucuccuucucggcaucaagcuuaccaugaacuuccuccuaagcuggguccacuggucccucgcccuacuccucuaccuacaccacgccaaauggucccaagccgcacccauggccgaaggcggcggccaaaaccaccacgaagucgucaaauucauggacgucuaccaacgcucauacugccaccccaucgaaacccucgucgacaucuuccaagaauaccccgacgaaauagaauacaucuucaaacccucaugcgucccccucaugcgcugcggcggcugcugcaacgacgaaggacucgaaugcguacccaccgaagaaucaaacaucacaaugcaaaucaugcgcaucaaaccccaccaaggccaacacaucggcgaaauguccuuccuccaacacaacaaaugcgaaugccgccccaaaaaagaccgagcacgacaagaaaaaaaauccguccgaggcaaaggcaaaggccaaaaacgaaaaagaaaaaaaucccgcuacaaauccugguccguauacgucggcgcccgaugcugccucaugccauggucccuccccggcccccacccaugcggccccugcuccgaacgccgcaaacaccucuucguccaagacccccaaaccugcaaaugcuccugcaaaaacaccgacuccagaugcaaagcccgccaacucgaacucaacgaacgcaccugucgcugcgacaaaccccgacgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5928 - RNA, 1006 nt, Artificial Sequence
  mRNA product Design2 comprising derived and/or modified sequence from Homo sapiens__NP_003368.1__HsVEGFB (opt11)
ggggcgcugccuacggagguggcagccaucuccuucucggcaucaagcuuaccauguccccccuccuccgccgccuccuccucgcagcccuacuccaacuagcccccgcacaagcccccgucucccaacccgacgcccccggccaccaacgcaaaguagucuccuggauagacgucuacacccgcgccaccugucaaccccgcgaagucguagucccccucacagucgaacucaugggcacagucgccaaacaacucguacccucaugcgucaccguccaaagaugcggcggcugcugccccgacgacggccucgaaugcguccccaccggccaacaccaaguccgcaugcaaauacucaugauccgauacccaucaucccaacuaggagaaaugucacucgaagaacacucucaaugcgaaugcagacccaaaaaaaaagacucagccguaaaaccagaccgcgccgcaacaccccaccaccgcccccaaccacgaucaguccccggcugggacuccgcccccggcgcccccucccccgccgacaucacccaccccacccccgcccccggcccauccgcccacgccgcccccuccaccaccucugcccuaacccccggccccgccgccgccgccgcagacgccgccgccucauccgucgccaaaggcggcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5929 - RNA, 1538 nt, Artificial Sequence
  mRNA product Design3 comprising derived and/or modified sequence from Homo sapiens__NP_001191.1__HsBMP2 (opt11)
gggagagucccgcagucggcguccagcggcucugcuuguucgugugugugucguugcaggccuuauucaagcuuaccauggucgccggcacccguugccuccuugcccuccuccuaccccaaguccuacuaggcggagcagccggccucguccccgaacucggccgccgcaaauucgccgccgccucauccggacgccccuccucacaacccagcgacgaaguacucucagaauuugaacuucgucuacucuccauguucggccucaaacaacgacccacucccucccgcgacgcagucguccccccuuacaugcuagaccuuuaccgccgccacuccggccaacccggaucacccgcccccgaccaucgccucgaaagagccgccucccgagccaauaccguccgcucauuccaccacgaagaaucacucgaagaacuacccgaaaccagcggaaaaacaacacgcagauucuucuucaaccucuccagcauccccaccgaagaauuuaucaccuccgccgaacuacaaguauucagagaacaaaugcaggacgcccucggcaacaacuccagcuuccaccaccgcaucaacauauacgaaauaaucaaacccgccacagcuaacuccaaguuccccgucacacgccuacucgacacccgccuagucaaccaaaaugccucccgcugggaauccuucgacgucacccccgccgucaugcgauggaccgcacaaggccacgccaaucacggcuucgucguagaaguugcacaccuagaagaaaaacaaggcgucuccaaacgccacguccgcaucuccagaucccuacaccaagacgaacacucauggucccaaauccgcccccuccuagucaccuucggacaugacggcaaaggacacccgcuccacaaacgcgaaaaacgccaagccaaacacaaacaacgcaaacgccucaaaucauccugcaaacgccacccacucuacguagacuucuccgacguaggauggaacgacuggauagucgcacccccaggcuaccacgcauucuacugccacggagaaugcccauucccacuugccgaccaccucaacuccaccaaccacgcuaucguacaaacacucgucaacuccgucaacucaaaaaucccaaaagcaugcugcguccccacagaacucucagccaucuccaugcucuaccucgacgaaaacgaaaaggucguccuaaaaaacuaccaagacauggucgucgaaggcugcggcugccgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5930 - RNA, 1643 nt, Artificial Sequence
  mRNA product Design3 comprising derived and/or modified sequence from Homo sapiens__NP_001710.1__HsBMP7 (opt11)
gggagagucccgcagucggcguccagcggcucugcuuguucgugugugugucguugcaggccuuauucaagcuuaccaugcacguccgaucacuacgcgccgcagccccacacuccuucguagcacucugggcaccccuauucuuacuccgcuccgcacuagccgacuucucccucgacaacgaaguccacucgagcuucauccaccgccgccuacggucccaagaaagacgcgaaaugcaacgcgaaauccucucaauucuaggacucccccaccgcccccgcccccaccuccaaggcaaacacaacucugcccccauguucaugcucgaccucuacaacgccauggcaguagaagaaggaggcggacccggcggccaaggcuucucauaccccuacaaagccguuuucucaacccaaggcccgccccucgcaucccuccaagacucacacuuccuaaccgacgccgacaugguaaugucauucgucaaccucguagaacaugacaaagaauuuuuccacccccgcuaucaccaccgcgaauuucgauucgaccucucgaaaauacccgaaggcgaagccgugaccgcagccgaauuucgcauauacaaagacuacauccgcgaacgcuucgacaacgaaacauuccgcaucuccgucuaccaagugcuccaagaacaccucggccgcgaaagcgaccucuuccuacuugacucccgcacacuuugggccucugaagaagguuggcucguauucgacauaacagccaccucaaaccacuggguagucaacccccgucacaaccuaggacuccagcuaucaguagaaacacucgacggccagagcaucaaccccaaacuugcgggacucaucggccgccacggaccacaaaacaagcagcccuucauggucgccuucuuuaaagccaccgaaguacauuucagauccauacgcuccaccggguccaaacaacgaucacaaaaccgauccaaaaccccaaaaaaccaagaagcucuacgaauggcaaacguagcugaaaacagcuccucagaccaacgccaagccugcaaaaaacacgaacucuacgucuccuuccgagaccucggcuggcaagacuggaucaucgccccagaaggcuacgcagcauacuacugcgaaggcgaaugcgccuucccccuuaacucuuacaugaacgccaccaaccacgcaaucguccagacccucguacacuucaucaaccccgaaacuguccccaaacccugcugcgcccccacccaauuaaacgcaaucuccguccucuacuucgacgacuccucgaacgucauacucaaaaaauaccgaaacauggucguccgcgccugcggcugccauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5931 - RNA, 647 nt, Artificial Sequence
  mRNA product Design3 comprising derived and/or modified sequence from Homo sapiens__NP_006264.2__HsCCL7 (opt11)
gggagagucccgcagucggcguccagcggcucugcuuguucgugugugugucguugcaggccuuauucaagcuuaccaugaaagccuccgccgcccuccucugccuccuccucaccgccgccgccuucuccccccaaggccuagcccaacccgucggcaucaacaccuccaccaccuguugcuaccgauucaucaacaaaaaaauccccaaacaacgccucgaauccuaccgccgcaccaccuccucacacugcccccgcgaagccgucaucuucaaaaccaaacucgacaaagaaaucugcgccgaccccacccaaaaauggguccaagacuucaugaaacaccucgacaaaaaaacccaaacccccaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5932 - RNA, 932 nt, Artificial Sequence
  mRNA product Design3 comprising derived and/or modified sequence from Homo sapiens__NP_002000.1__HsFGF7 (opt11)
gggagagucccgcagucggcguccagcggcucugcuuguucgugugugugucguugcaggccuuauucaagcuuaccaugcacaaauggauccucaccuggauccuccccacccuccucuaccgcuccugcuuccacaucaucugccucgucggcaccaucucccucgccugcaacgacaugacccccgaacaaauggccacaaacgucaacugcuccucccccgaacgccacacccgcuccuacgacuacauggaaggcggcgacauccgcguccgccgacucuucugccgcacccaaugguaccuacgcaucgacaaacgcggcaaaguaaaaggcacccaagaaaugaaaaacaacuacaacaucauggaaauccgcacagucgccgucggcauagucgcaaucaaaggcgucgaauccgaauuuuaccucgccaugaacaaagaaggcaaacucuacgccaaaaaagaaugcaacgaagacugcaacuucaaagaacucauccucgaaaaccacuacaacaccuacgccuccgccaaauggacccacaacggcggcgaaauguucgucgcccucaaccaaaaaggcauccccguccgcggcaaaaaaaccaaaaaagaacaaaaaaccgcccacuuccuccccauggccaucaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5933 - RNA, 1451 nt, Artificial Sequence
  mRNA product Design3 comprising derived and/or modified sequence from Homo sapiens__P48741__HsHSPA7 (opt11)
gggagagucccgcagucggcguccagcggcucugcuuguucgugugugugucguugcaggccuuauucaagcuuaccaugcaagccccccgcgaacuagccguaggcaucgaccucggcacaaccuacagcugugucggcguauuccaacaaggcagaguagaaauccuagccaacgaccaaggcaacagaacgaccccaucauacgucgcguucaccgacacagaaaggcuaguaggagacgcagcaaaaucccaagcagcccuaaacccgcacaacacuguauucgacgccaaacgccuaaucggacgaaaauucgcagacacaaccguccaaucagacaugaaacacuggccauuccaagucgucuccgaagguggaaaacccaaaguacgaguaugcuaccgaggggaagacaaaacauucuacccagaagaaauaagcucaaugguacuaagcaaaaugaaagaaaccgcggaagccuaccuaggccaaccaguaaaacacgccguaaucacggucccgaccuacuucagcaacucccagagacaggccaccaaagacgcaggagcaaucgcaggccuaaaaguacucccaaucauaaacgaagccacagccgcagcaauagccuacggccuggaccgaagaggagccggcaaacgaaacguacucauauucgaccuaggaggaggaacauucgacguauccguacucucgaucgacgccggggucuucgaaguaaaagcuaccgccggcgacacccaccuaggaggcgaagacuucgacaaccgccuagucaaccacuucauggaagaauuucgcagaaaacacggcaaagaccuaagcggaaacaaacgagcccucagacgacuccgaacagccugcgaacgagccaaacgcaccccaucaagcagcacccaggccacacuagaaaucgacucccuauucgaaggcguagacuucuacaaaagcaucaccagagccagauucgaagaacucugcagcgaccuauuccgaagcacccuagaacccguggaaaaagcccuccgcgacgccaaacuagacaaagcacaaauccacgacuucguacuaggcggcgggcuccacagccacccacaaggcgcagaagucgccgcaggccuacuccaacgacaaggcgcagaacaagaacaccagccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5934 - RNA, 2522 nt, Artificial Sequence
  mRNA product Design3 comprising derived and/or modified sequence from Homo sapiens__NP_031381.2__HsHSP90AB1 (opt11)
gggagagucccgcagucggcguccagcggcucugcuuguucgugugugugucguugcaggccuuauucaagcuuaccaugcccgaagaagugcaccacggggaagaggaagucgaaaccuucgccuuccaggccgagauagcccaacucaugagcuuaaucauaaacaccuucuacuccaacaaagaaaucuuccucagagaguugauaucaaacgcaagcgacgcccuggacaagauaagauacgaaagccuaacagacccaucaaaacuggacucaggaaaggaguuaaaaauagacaucaucccaaacccacaagaacgcacgcucacccucguggacaccggaauaggaaugacaaaagccgaccucauaaacaaucucggcacgauagccaagagcgggacaaaagccuucauggaggcccuacaagcaggagccgacauaagcaugaucggacaauucggcguaggcuucuacagcgcauaccucgucgccgaaaaggugguaguaaucacaaaacacaacgacgacgaacaauacgccugggaaagcagcgccggcgggagcuucacagucagagcagaccacggcgaaccuauaggacgcgggacuaaaguaauccuccaccuaaaggaagaccaaaccgaauacuuagaagaacgcagggucaaggaagucgucaaaaaacacagccaguucaucggcuaccccauaacccucuaccuggaaaaagagagggaaaaggaaauaagugacgacgaggccgaggaagaaaaaggagaaaaagaagaagaagacaaagacgacgaagaaaagcccaagaucgaagacguaggaagcgacgaagaagacgacucaggaaaggacaagaaaaaaaaaacgaaaaaaaucaaagagaaauacaucgaccaagaagaacugaacaaaacaaaaccaaucuggaccaggaaccccgaugacaucacacaagaagaauacggggaauuuuacaaaucgcuaacaaacgacugggaggaccaccucgcgguaaagcacuucagcguggaaggacaacucgaauuuagagcacuacuauucaucccaaggagagcgccauucgaccuguucgaaaacaagaaaaaaaaaaacaacauaaagcuauacguccgacgagucuucauaauggacucaugcgacgaacugaucccagaauaccuaaacuucauccggggcguaguagacuccgaagaccucccacucaacaucagccgagaaaugcuacaacagagcaagauacugaaagugaucagaaaaaacaucguaaaaaagugccuagaacuauucagcgaauuagcagaggauaaagaaaacuacaagaaauucuacgaagccuucagcaagaaccuaaaacugggcauacacgaagacagcaccaaucgaaggcgccuaagcgaacuacuaagauaccacacaagucagagcggcgacgagaugacgagccuauccgaauacguuagccggaugaaagaaacgcaaaagucaauauacuacaucaccggagagagcaaggaacaaguagcgaacucggcauucgucgaacgcgugcgaaagcgcggauucgaagucguauacaugacggagcccaucgacgaguacuguguacaacagcucaaagaauuugacggcaaaagccuagucucaguaaccaaagaaggacuagaauugcccgaagacgaagaagagaagaaaaaaauggaagaaucaaaagccaaauucgagaacuugugcaagcugaugaaagagauccuagacaaaaagguagaaaaggucacgaucucaaaccggcuggugagcucgcccugcugcaucgucacgagcacauacggcuggacagcaaacauggaacgaauaaugaaagcacaagcccucagagacaacucaaccaugggguacaugauggccaagaaacaccucgaaauaaaccccgaccacccuauaguagaaacgcucaggcaaaaggccgaagcagacaaaaacgacaaagccguaaaagaccucgugguccugcucuuugaaacagcccuacucucaagcggauuuucacuggaggacccacaaacccacagcaacagaaucuaccgaaugauuaagcucggacuggguauugacgaggacgaaguagccgcggaagaacccaacgcggcaguccccgacgaaaucccgccccuggaaggggacgaggacgcaucaagaauggaagaggucgacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5935 - RNA, 986 nt, Artificial Sequence
  mRNA product Design3 comprising derived and/or modified sequence from Homo sapiens__NP_000591.1__HsIL6 (opt11)
gggagagucccgcagucggcguccagcggcucugcuuguucgugugugugucguugcaggccuuauucaagcuuaccaugaacuccuucuccaccuccgccuucggccccgucgccuucucccucggccuccuacucguacuccccgccgccuucccagcccccguccccccaggcgaagacuccaaagacgucgccgccccccaccgccaaccucucaccucauccgaacgcaucgacaaacaaauacgcuacauccucgacggcaucuccgcccuccgcaaagaaaccugcaacaaaucaaacaugugcgaauccucaaaagaagcccucgccgaaaacaaccuaaaccuccccaaaauggccgaaaaagacggcugcuuccaauccggcuucaacgaagaaacaugccucgucaaaauaaucaccggacuccucgaauuugaagucuaccucgaauaccuacaaaaccgcuucgaaucauccgaagaacaagcccgcgccguccaaaugucaaccaaaguccucauccaauuccuccaaaaaaaagccaaaaaccucgacgccaucacaacccccgaccccaccaccaacgccucccuacucaccaaacuccaagcccaaaaccaauggcuccaagacaugaccacccaccucauccuccgcuccuucaaagaauuucuccaauccucccuccgcgcccuccgacaaauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5936 - RNA, 1763 nt, Artificial Sequence
  mRNA product Design3 comprising derived and/or modified sequence from Homo sapiens__NP_002418.1__HsMMP13 (opt11)
gggagagucccgcagucggcguccagcggcucugcuuguucgugugugugucguugcaggccuuauucaagcuuaccaugcaccccggcguacucgcagccuuccuauuccuauccuggacccacugccgcgcauuaccccuccccucaggaggcgaugaagacgaccuuuccgaagaagaccugcaauucgccgaacgcuaccuccgauccuacuaccaccccaccaaccucgccggcauacucaaagaaaacgcagccucauccaugacagaacgccuccgcgaaaugcaauccuucuuuggccucgaagucaccggaaaacuugacgacaacacgcuagacgucaugaaaaaacccagaugcggaguccccgacgucggcgaauacaacgucuuccccagaacccuaaaauggucaaaaaugaaccucaccuacagaauagucaacuacaccccugacaugacccacuccgaaguagaaaaagccuucaaaaaagccuucaaagucuggucugacguuaccccccucaacuucacccgacuccacgacggcaucgccgacauaaugaucuccuucggaaucaaagaacacggcgacuucuaccccuucgacggaccaucaggccuacucgcccacgccuucccaccaggacccaacuacggaggcgacgcccacuucgaugacgacgaaaccuggaccuccuccuccaaaggcuacaaccucuuccuaguagccgcacacgaauuuggccacucacuaggacuagaccacuccaaagaccccggcgcucuuauguuccccaucuacaccuacacugggaaaucccacuucaugcuccccgacgacgacguacaaggcauccaaagccucuacggcccgggcgacgaagaucccaaccccaaacaccccaaaacaccagacaaaugcgaccccucacuaucacuagacgcaaucaccucccuccguggcgaaacuaugaucuucaaagaccgauucuucuggcgcuuacacccccaacaagucgacgccgaacucuuccuuaccaaaucauucuggcccgaacuccccaaccgcaucgacgccgccuacgaacaccccagccaugaccucaucuuuaucuuccgcgggagaaaauucugggcacuaaacggauacgacauacucgaaggcuacccaaaaaaaaucuccgaacuaggccucccaaaggaagucaaaaagaucuccgcagcaguacacuucgaagacaccggcaaaacccuccuauucucagguaaccaaguauggcgcuacgacgacaccaaccacaucauggacaaagacuacccccgccucaucgaagaagacuuccccggcauaggcgacaaagucgacgccgucuaugaaaaaaacggcuacauauacuucuuuaacggccccauccaauuugaauacuccauaugguccaaccgcaucguacgcguuaugccagccaacuccauccucuggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5937 - RNA, 1442 nt, Artificial Sequence
  mRNA product Design3 comprising derived and/or modified sequence from Homo sapiens__NP_149126.1__HsPDGFD (opt11)
gggagagucccgcagucggcguccagcggcucugcuuguucgugugugugucguugcaggccuuauucaagcuuaccaugcaccgccuaaucuucgucuacacccuaaucugcgccaacuucugcuccugccgagacaccuccgccaccccacaauccgccuccauaaaagcacuccggaaugccaacuuacgccgggacgaccuauaccgucgagacgaaacaauccaaguaaaaggaaacggcuacgugcaaucgccccgauucccaaacuccuacccacgcaaccuccuccucaccuggcgacuacacucccaagaaaacacucgcauccaacucgucuucgacaaccaguucggccuggaagaagccgaaaacgacaucugccgcuacgacuucgucgaagucgaagacauaucagaaaccuccaccaucauacgcggccgcuggugcggccacaaagagguacccccccgcaucaaaucccgcacaaaccaaaucaaaauaaccuucaaaucagacgacuacuucguagcuaaacccggauucaaaaucuacuacucccuccuagaagacuuccaacccgccgcagcauccgagaccaacugggaauccguaaccuccuccauauccggcguauccuacaacagccccuccgucacagaccccacccuuauagccgacgcccucgacaaaaaaaucgccgaauuugacaccgucgaagaucuccuaaaauacuucaaccccgaaucauggcaagaagaccucgaaaacauguaccuagacaccccacgauaccgcggacgcucauaccacgaccgaaaauccaaagucgaccucgaccgacucaacgacgacgccaaacgcuacagcugcacaccacgcaacuacuccgucaacauccgcgaagaacuaaaacucgccaacguagucuucuucccccgcugccuucucguccaaagaugcggcggcaacugcggcuguggaaccguaaacuggcgcagcugcaccuguaacucaggcaaaaccgucaaaaaauaccacgaaguccuccaauucgaaccaggccacaucaaacgccgcggccgagccaaaacaauggcccucgucgacauccagcucgaccaccacgaacgcugcgacugcauaugcuccagccgccccccucgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5938 - RNA, 1025 nt, Artificial Sequence
  mRNA product Design3 comprising derived and/or modified sequence from Homo sapiens__NP_003946.3__HsSOCS3 (opt11)
gggagagucccgcagucggcguccagcggcucugcuuguucgugugugugucguugcaggccuuauucaagcuuaccauggucacccacuccaaauucccugccgcaggcaugucccgaccccucgacaccucccuccgacucaaaaccuucuccucaaaguccgaauaccaacucgucgucaacgccguccguaaacuccaagaauccggcuucuacugguccgccgucaccgguggugaagcaaaccuccuccucuccgcagaacccgccggcaccuuccucauccgcgacuccucagaccaacgccacuucuucacccucucagucaaaacccaauccggcaccaaaaaccuccgcauccaaugcgaaggcggcuccuucucccuccaauccgacccacgcuccacacaaccugucccacgcuucgacugcguccucaaacucguccaccacuacaugccaccccccggcgcccccuccuucccauccccccccaccgaacccuccucagaaguccccgaacaacccucagcccaaccccuccccggcucccccccccgccgcgcauacuacaucuacuccggcggcgaaaaaaucccacucguacucucccgcccccucuccuccaacgucgccacccuacaacaccucugccgcaaaaccgucaacggccaccucgacuccuacgaaaaagucacccaacuacccggccccauccgcgaauuucucgaccaauacgaugcaccccuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5939 - RNA, 830 nt, Artificial Sequence
  mRNA product Design3 comprising derived and/or modified sequence from Homo sapiens__NP_003227.1__HsTGFA (opt11)
gggagagucccgcagucggcguccagcggcucugcuuguucgugugugugucguugcaggccuuauucaagcuuaccaugguccccuccgccggccaacucgcccuauucgcccucggaaucguccucgcagccugccaagcccucgaaaacuccaccuccccccucuccgccgacccccccgucgccgccgccgucgucucccacuucaacgacugccccgacucccacacccaauucugcuuccacggcaccugucgcuuccucguccaagaagacaaacccgccugcgucugccacuccggcuacgucggcgcccgcugcgaacacgccgaccuccucgccgucgucgccgccucccaaaaaaaacaagccaucaccgcccucgucgucgucuccaucgucgcccucgccguccucaucaucaccuguguccuaauccacugcugccaaguccgcaaacacugcgaauggugccgcgcccucaucugccgccacgaaaaacccuccgcccuccucaaaggccgcaccgccugcugccacuccgaaacagucguuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5940 - RNA, 1592 nt, Artificial Sequence
  mRNA product Design3 comprising derived and/or modified sequence from Homo sapiens__NP_003229.1__HsTGFB2 (opt11)
gggagagucccgcagucggcguccagcggcucugcuuguucgugugugugucguugcaggccuuauucaagcuuaccaugcacuacugcguccucuccgccuuccucauauuacaccucgucaccguugcccuaucccucucgacuugcuccacccucgacauggaccaauucaugcgcaaaagaaucgaagcaauccgaggccaaauccucucaaaacucaaacuuacaucccccccugaagacuauccagaacccgaggaaguccccccugaagucauauccauauacaacagcacccgcgaccuacuccaagaaaaagccucgcgacgagccgcagccugcgaacgcgaacgcagcgacgaagaauacuacgccaaggaagucuacaaaaucgacaugccgcccuucuucccaucagagaaugcuaucccccccaccuucuaccgaccauacuuccgcaucguccgcuucgacgucuccgcaauggaaaaaaacgccuccaaccucgucaaagccgaauuucgcgucuuccgccugcaaaaccccaaagcccgcguucccgaacaacgcaucgaacucuaccaaauacucaaauccaaagaccucaccucucccacccaacguuacaucgacucuaaaguagucaaaacacgcgccgaaggcgaauggcucuccuucgacguaaccgacgccguacacgaauggcuccaccacaaagacagaaaccucggauucaaaaucucccuacacugccccugcugcacuuucguccccuccaacaacuacauaauucccaacaaauccgaagaacuugaagcccgcuucgccggcaucgacggaaccucgaccuacacuucaggcgaccagaaaaccauuaaauccacccgcaaaaaaaacucgggcaaaacaccccaccuccuacucaugcuccucccauccuaccggcuagaaucccaacaaaccaaccgacgcaaaaaacgagcccucgacgcagccuacugcuuccguaacguccaagacaauugcugccuacgcccacucuacaucgauuucaaacgugaccucggauggaaauggauccaugaacccaaaggcuacaacgccaacuucugcgcaggcgcaugccccuaccucuggagcuccgacacccaacacucccgcguccuaagccuuuacaacaccaucaaccccgaagccucagccucccccugcugcgucucccaagaccucgaaccacuaacaauccucuacuacaucggcaaaacccccaaaauagaacaacucuccaacaugaucgucaaauccugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5941 - RNA, 1733 nt, Artificial Sequence
  mRNA product Design3 comprising derived and/or modified sequence from Homo sapiens__NP_001057.1__HsTNFRSF1B (opt11)
gggagagucccgcagucggcguccagcggcucugcuuguucgugugugugucguugcaggccuuauucaagcuuaccauggcaccagucgcagucugggccgcccucgccguaggccuugaacucugggcagccgcccacgcccucccagcacaagucgcauucacucccuacgcacccgaacccggcuccaccugucgccuacgcgaauacuaugaccaaacagcacaaaugugcugcuccaaaugcucucccggccaacacgcuaaaguauucugcacaaaaaccucugacaccguaugcgacucaugcgaagacuccacauauacccaacucuggaacuggguccccgaaugccucuccugcggcucccgcugcagcucagaccaaguagaaacccaagcaugcacccgcgagcaaaaccgcaucugcacaugccgccccggcugguacugcgcucucuccaaacaagaaggcugcagacuuugugcaccucugaggaaaugccgaccaggcuuugguguagcaagacccgguaccgaaaccucagacgucgucugcaaaccgugugcacccggcaccuucucaaacaccaccuccucuaccgacaucugccgaccacaucaaaucugcaacguagucgccaucccaggcaacgccuccauggacgccguaugcaccucgaccucccccacccgcuccauggcccccggcgccguacaccuaccccaacccgucuccacccgaucccagcacacccaacccaccccagaacccagcaccgccccgucaaccucauuccuacucccaaugggccccuccccacccgcagaaggcuccacaggcgauuucgcccuccccguaggacuaauaguuggcgucaccgcccuaggccuccuuaucaucggcguagucaacugcgucaucaugacccaagucaaaaaaaaaccccucugccuccaacgcgaagccaaagucccacaccucccagccgacaaagcccgcggaacccaaggccccgaacaacaacaccuccucaucaccgcccccucaucaagcuccuccucacucgaaucauccgccuccgcccucgaucgacgcgcccccacacgcaaccaaccacaagccccaggcguagaagcguccggcgccggcgaagcccgcgccuccaccggcucguccgacuccucaccaggaggucacggcacccaaguaaaugucaccuguaucgugaacguuuguuccuccucagaucacagcucccaauguucuucccaagccuccuccacaaugggcgacaccgauuccagccccucagaaucccccaaagacgaacaagucccauucucaaaagaagagugugccuuccgaucccagcucgaaacaccagaaacccuacucgguucaaccgaagaaaaaccccucccccucggcgucccagacgcaggcaugaaacccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5942 - RNA, 1046 nt, Artificial Sequence
  mRNA product Design3 comprising derived and/or modified sequence from Homo sapiens__NP_001165094.1__HsVEGFA (opt11)
gggagagucccgcagucggcguccagcggcucugcuuguucgugugugugucguugcaggccuuauucaagcuuaccaugaacuuccuccuaagcuggguccacuggucccucgcccuacuccucuaccuacaccacgccaaauggucccaagccgcacccauggccgaaggcggcggccaaaaccaccacgaagucgucaaauucauggacgucuaccaacgcucauacugccaccccaucgaaacccucgucgacaucuuccaagaauaccccgacgaaauagaauacaucuucaaacccucaugcgucccccucaugcgcugcggcggcugcugcaacgacgaaggacucgaaugcguacccaccgaagaaucaaacaucacaaugcaaaucaugcgcaucaaaccccaccaaggccaacacaucggcgaaauguccuuccuccaacacaacaaaugcgaaugccgccccaaaaaagaccgagcacgacaagaaaaaaaauccguccgaggcaaaggcaaaggccaaaaacgaaaaagaaaaaaaucccgcuacaaauccugguccguauacgucggcgcccgaugcugccucaugccauggucccuccccggcccccacccaugcggccccugcuccgaacgccgcaaacaccucuucguccaagacccccaaaccugcaaaugcuccugcaaaaacaccgacuccagaugcaaagcccgccaacucgaacucaacgaacgcaccugucgcugcgacaaaccccgacgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5943 - RNA, 971 nt, Artificial Sequence
  mRNA product Design3 comprising derived and/or modified sequence from Homo sapiens__NP_003368.1__HsVEGFB (opt11)
gggagagucccgcagucggcguccagcggcucugcuuguucgugugugugucguugcaggccuuauucaagcuuaccauguccccccuccuccgccgccuccuccucgcagcccuacuccaacuagcccccgcacaagcccccgucucccaacccgacgcccccggccaccaacgcaaaguagucuccuggauagacgucuacacccgcgccaccugucaaccccgcgaagucguagucccccucacagucgaacucaugggcacagucgccaaacaacucguacccucaugcgucaccguccaaagaugcggcggcugcugccccgacgacggccucgaaugcguccccaccggccaacaccaaguccgcaugcaaauacucaugauccgauacccaucaucccaacuaggagaaaugucacucgaagaacacucucaaugcgaaugcagacccaaaaaaaaagacucagccguaaaaccagaccgcgccgcaacaccccaccaccgcccccaaccacgaucaguccccggcugggacuccgcccccggcgcccccucccccgccgacaucacccaccccacccccgcccccggcccauccgcccacgccgcccccuccaccaccucugcccuaacccccggccccgccgccgccgccgcagacgccgccgccucauccgucgccaaaggcggcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5944 - RNA, 1467 nt, Artificial Sequence
  mRNA product Design5 comprising derived and/or modified sequence from Homo sapiens__NP_001191.1__HsBMP2 (opt11)
gggagagucccgcagucggcguccagcggcucugcuuguucgugugugugucguugcaggccuuauucaagcuuaccauggucgccggcacccguugccuccuugcccuccuccuaccccaaguccuacuaggcggagcagccggccucguccccgaacucggccgccgcaaauucgccgccgccucauccggacgccccuccucacaacccagcgacgaaguacucucagaauuugaacuucgucuacucuccauguucggccucaaacaacgacccacucccucccgcgacgcagucguccccccuuacaugcuagaccuuuaccgccgccacuccggccaacccggaucacccgcccccgaccaucgccucgaaagagccgccucccgagccaauaccguccgcucauuccaccacgaagaaucacucgaagaacuacccgaaaccagcggaaaaacaacacgcagauucuucuucaaccucuccagcauccccaccgaagaauuuaucaccuccgccgaacuacaaguauucagagaacaaaugcaggacgcccucggcaacaacuccagcuuccaccaccgcaucaacauauacgaaauaaucaaacccgccacagcuaacuccaaguuccccgucacacgccuacucgacacccgccuagucaaccaaaaugccucccgcugggaauccuucgacgucacccccgccgucaugcgauggaccgcacaaggccacgccaaucacggcuucgucguagaaguugcacaccuagaagaaaaacaaggcgucuccaaacgccacguccgcaucuccagaucccuacaccaagacgaacacucauggucccaaauccgcccccuccuagucaccuucggacaugacggcaaaggacacccgcuccacaaacgcgaaaaacgccaagccaaacacaaacaacgcaaacgccucaaaucauccugcaaacgccacccacucuacguagacuucuccgacguaggauggaacgacuggauagucgcacccccaggcuaccacgcauucuacugccacggagaaugcccauucccacuugccgaccaccucaacuccaccaaccacgcuaucguacaaacacucgucaacuccgucaacucaaaaaucccaaaagcaugcugcguccccacagaacucucagccaucuccaugcucuaccucgacgaaaacgaaaaggucguccuaaaaaacuaccaagacauggucgucgaaggcugcggcugccgcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5945 - RNA, 1572 nt, Artificial Sequence
  mRNA product Design5 comprising derived and/or modified sequence from Homo sapiens__NP_001710.1__HsBMP7 (opt11)
gggagagucccgcagucggcguccagcggcucugcuuguucgugugugugucguugcaggccuuauucaagcuuaccaugcacguccgaucacuacgcgccgcagccccacacuccuucguagcacucugggcaccccuauucuuacuccgcuccgcacuagccgacuucucccucgacaacgaaguccacucgagcuucauccaccgccgccuacggucccaagaaagacgcgaaaugcaacgcgaaauccucucaauucuaggacucccccaccgcccccgcccccaccuccaaggcaaacacaacucugcccccauguucaugcucgaccucuacaacgccauggcaguagaagaaggaggcggacccggcggccaaggcuucucauaccccuacaaagccguuuucucaacccaaggcccgccccucgcaucccuccaagacucacacuuccuaaccgacgccgacaugguaaugucauucgucaaccucguagaacaugacaaagaauuuuuccacccccgcuaucaccaccgcgaauuucgauucgaccucucgaaaauacccgaaggcgaagccgugaccgcagccgaauuucgcauauacaaagacuacauccgcgaacgcuucgacaacgaaacauuccgcaucuccgucuaccaagugcuccaagaacaccucggccgcgaaagcgaccucuuccuacuugacucccgcacacuuugggccucugaagaagguuggcucguauucgacauaacagccaccucaaaccacuggguagucaacccccgucacaaccuaggacuccagcuaucaguagaaacacucgacggccagagcaucaaccccaaacuugcgggacucaucggccgccacggaccacaaaacaagcagcccuucauggucgccuucuuuaaagccaccgaaguacauuucagauccauacgcuccaccggguccaaacaacgaucacaaaaccgauccaaaaccccaaaaaaccaagaagcucuacgaauggcaaacguagcugaaaacagcuccucagaccaacgccaagccugcaaaaaacacgaacucuacgucuccuuccgagaccucggcuggcaagacuggaucaucgccccagaaggcuacgcagcauacuacugcgaaggcgaaugcgccuucccccuuaacucuuacaugaacgccaccaaccacgcaaucguccagacccucguacacuucaucaaccccgaaacuguccccaaacccugcugcgcccccacccaauuaaacgcaaucuccguccucuacuucgacgacuccucgaacgucauacucaaaaaauaccgaaacauggucguccgcgccugcggcugccauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5946 - RNA, 576 nt, Artificial Sequence
  mRNA product Design5 comprising derived and/or modified sequence from Homo sapiens__NP_006264.2__HsCCL7 (opt11)
gggagagucccgcagucggcguccagcggcucugcuuguucgugugugugucguugcaggccuuauucaagcuuaccaugaaagccuccgccgcccuccucugccuccuccucaccgccgccgccuucuccccccaaggccuagcccaacccgucggcaucaacaccuccaccaccuguugcuaccgauucaucaacaaaaaaauccccaaacaacgccucgaauccuaccgccgcaccaccuccucacacugcccccgcgaagccgucaucuucaaaaccaaacucgacaaagaaaucugcgccgaccccacccaaaaauggguccaagacuucaugaaacaccucgacaaaaaaacccaaacccccaaacucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5947 - RNA, 861 nt, Artificial Sequence
  mRNA product Design5 comprising derived and/or modified sequence from Homo sapiens__NP_002000.1__HsFGF7 (opt11)
gggagagucccgcagucggcguccagcggcucugcuuguucgugugugugucguugcaggccuuauucaagcuuaccaugcacaaauggauccucaccuggauccuccccacccuccucuaccgcuccugcuuccacaucaucugccucgucggcaccaucucccucgccugcaacgacaugacccccgaacaaauggccacaaacgucaacugcuccucccccgaacgccacacccgcuccuacgacuacauggaaggcggcgacauccgcguccgccgacucuucugccgcacccaaugguaccuacgcaucgacaaacgcggcaaaguaaaaggcacccaagaaaugaaaaacaacuacaacaucauggaaauccgcacagucgccgucggcauagucgcaaucaaaggcgucgaauccgaauuuuaccucgccaugaacaaagaaggcaaacucuacgccaaaaaagaaugcaacgaagacugcaacuucaaagaacucauccucgaaaaccacuacaacaccuacgccuccgccaaauggacccacaacggcggcgaaauguucgucgcccucaaccaaaaaggcauccccguccgcggcaaaaaaaccaaaaaagaacaaaaaaccgcccacuuccuccccauggccaucaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5948 - RNA, 1380 nt, Artificial Sequence
  mRNA product Design5 comprising derived and/or modified sequence from Homo sapiens__P48741__HsHSPA7 (opt11)
gggagagucccgcagucggcguccagcggcucugcuuguucgugugugugucguugcaggccuuauucaagcuuaccaugcaagccccccgcgaacuagccguaggcaucgaccucggcacaaccuacagcugugucggcguauuccaacaaggcagaguagaaauccuagccaacgaccaaggcaacagaacgaccccaucauacgucgcguucaccgacacagaaaggcuaguaggagacgcagcaaaaucccaagcagcccuaaacccgcacaacacuguauucgacgccaaacgccuaaucggacgaaaauucgcagacacaaccguccaaucagacaugaaacacuggccauuccaagucgucuccgaagguggaaaacccaaaguacgaguaugcuaccgaggggaagacaaaacauucuacccagaagaaauaagcucaaugguacuaagcaaaaugaaagaaaccgcggaagccuaccuaggccaaccaguaaaacacgccguaaucacggucccgaccuacuucagcaacucccagagacaggccaccaaagacgcaggagcaaucgcaggccuaaaaguacucccaaucauaaacgaagccacagccgcagcaauagccuacggccuggaccgaagaggagccggcaaacgaaacguacucauauucgaccuaggaggaggaacauucgacguauccguacucucgaucgacgccggggucuucgaaguaaaagcuaccgccggcgacacccaccuaggaggcgaagacuucgacaaccgccuagucaaccacuucauggaagaauuucgcagaaaacacggcaaagaccuaagcggaaacaaacgagcccucagacgacuccgaacagccugcgaacgagccaaacgcaccccaucaagcagcacccaggccacacuagaaaucgacucccuauucgaaggcguagacuucuacaaaagcaucaccagagccagauucgaagaacucugcagcgaccuauuccgaagcacccuagaacccguggaaaaagcccuccgcgacgccaaacuagacaaagcacaaauccacgacuucguacuaggcggcgggcuccacagccacccacaaggcgcagaagucgccgcaggccuacuccaacgacaaggcgcagaacaagaacaccagccauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5949 - RNA, 2451 nt, Artificial Sequence
  mRNA product Design5 comprising derived and/or modified sequence from Homo sapiens__NP_031381.2__HsHSP90AB1 (opt11)
gggagagucccgcagucggcguccagcggcucugcuuguucgugugugugucguugcaggccuuauucaagcuuaccaugcccgaagaagugcaccacggggaagaggaagucgaaaccuucgccuuccaggccgagauagcccaacucaugagcuuaaucauaaacaccuucuacuccaacaaagaaaucuuccucagagaguugauaucaaacgcaagcgacgcccuggacaagauaagauacgaaagccuaacagacccaucaaaacuggacucaggaaaggaguuaaaaauagacaucaucccaaacccacaagaacgcacgcucacccucguggacaccggaauaggaaugacaaaagccgaccucauaaacaaucucggcacgauagccaagagcgggacaaaagccuucauggaggcccuacaagcaggagccgacauaagcaugaucggacaauucggcguaggcuucuacagcgcauaccucgucgccgaaaaggugguaguaaucacaaaacacaacgacgacgaacaauacgccugggaaagcagcgccggcgggagcuucacagucagagcagaccacggcgaaccuauaggacgcgggacuaaaguaauccuccaccuaaaggaagaccaaaccgaauacuuagaagaacgcagggucaaggaagucgucaaaaaacacagccaguucaucggcuaccccauaacccucuaccuggaaaaagagagggaaaaggaaauaagugacgacgaggccgaggaagaaaaaggagaaaaagaagaagaagacaaagacgacgaagaaaagcccaagaucgaagacguaggaagcgacgaagaagacgacucaggaaaggacaagaaaaaaaaaacgaaaaaaaucaaagagaaauacaucgaccaagaagaacugaacaaaacaaaaccaaucuggaccaggaaccccgaugacaucacacaagaagaauacggggaauuuuacaaaucgcuaacaaacgacugggaggaccaccucgcgguaaagcacuucagcguggaaggacaacucgaauuuagagcacuacuauucaucccaaggagagcgccauucgaccuguucgaaaacaagaaaaaaaaaaacaacauaaagcuauacguccgacgagucuucauaauggacucaugcgacgaacugaucccagaauaccuaaacuucauccggggcguaguagacuccgaagaccucccacucaacaucagccgagaaaugcuacaacagagcaagauacugaaagugaucagaaaaaacaucguaaaaaagugccuagaacuauucagcgaauuagcagaggauaaagaaaacuacaagaaauucuacgaagccuucagcaagaaccuaaaacugggcauacacgaagacagcaccaaucgaaggcgccuaagcgaacuacuaagauaccacacaagucagagcggcgacgagaugacgagccuauccgaauacguuagccggaugaaagaaacgcaaaagucaauauacuacaucaccggagagagcaaggaacaaguagcgaacucggcauucgucgaacgcgugcgaaagcgcggauucgaagucguauacaugacggagcccaucgacgaguacuguguacaacagcucaaagaauuugacggcaaaagccuagucucaguaaccaaagaaggacuagaauugcccgaagacgaagaagagaagaaaaaaauggaagaaucaaaagccaaauucgagaacuugugcaagcugaugaaagagauccuagacaaaaagguagaaaaggucacgaucucaaaccggcuggugagcucgcccugcugcaucgucacgagcacauacggcuggacagcaaacauggaacgaauaaugaaagcacaagcccucagagacaacucaaccaugggguacaugauggccaagaaacaccucgaaauaaaccccgaccacccuauaguagaaacgcucaggcaaaaggccgaagcagacaaaaacgacaaagccguaaaagaccucgugguccugcucuuugaaacagcccuacucucaagcggauuuucacuggaggacccacaaacccacagcaacagaaucuaccgaaugauuaagcucggacuggguauugacgaggacgaaguagccgcggaagaacccaacgcggcaguccccgacgaaaucccgccccuggaaggggacgaggacgcaucaagaauggaagaggucgacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5950 - RNA, 915 nt, Artificial Sequence
  mRNA product Design5 comprising derived and/or modified sequence from Homo sapiens__NP_000591.1__HsIL6 (opt11)
gggagagucccgcagucggcguccagcggcucugcuuguucgugugugugucguugcaggccuuauucaagcuuaccaugaacuccuucuccaccuccgccuucggccccgucgccuucucccucggccuccuacucguacuccccgccgccuucccagcccccguccccccaggcgaagacuccaaagacgucgccgccccccaccgccaaccucucaccucauccgaacgcaucgacaaacaaauacgcuacauccucgacggcaucuccgcccuccgcaaagaaaccugcaacaaaucaaacaugugcgaauccucaaaagaagcccucgccgaaaacaaccuaaaccuccccaaaauggccgaaaaagacggcugcuuccaauccggcuucaacgaagaaacaugccucgucaaaauaaucaccggacuccucgaauuugaagucuaccucgaauaccuacaaaaccgcuucgaaucauccgaagaacaagcccgcgccguccaaaugucaaccaaaguccucauccaauuccuccaaaaaaaagccaaaaaccucgacgccaucacaacccccgaccccaccaccaacgccucccuacucaccaaacuccaagcccaaaaccaauggcuccaagacaugaccacccaccucauccuccgcuccuucaaagaauuucuccaauccucccuccgcgcccuccgacaaauguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5951 - RNA, 1692 nt, Artificial Sequence
  mRNA product Design5 comprising derived and/or modified sequence from Homo sapiens__NP_002418.1__HsMMP13 (opt11)
gggagagucccgcagucggcguccagcggcucugcuuguucgugugugugucguugcaggccuuauucaagcuuaccaugcaccccggcguacucgcagccuuccuauuccuauccuggacccacugccgcgcauuaccccuccccucaggaggcgaugaagacgaccuuuccgaagaagaccugcaauucgccgaacgcuaccuccgauccuacuaccaccccaccaaccucgccggcauacucaaagaaaacgcagccucauccaugacagaacgccuccgcgaaaugcaauccuucuuuggccucgaagucaccggaaaacuugacgacaacacgcuagacgucaugaaaaaacccagaugcggaguccccgacgucggcgaauacaacgucuuccccagaacccuaaaauggucaaaaaugaaccucaccuacagaauagucaacuacaccccugacaugacccacuccgaaguagaaaaagccuucaaaaaagccuucaaagucuggucugacguuaccccccucaacuucacccgacuccacgacggcaucgccgacauaaugaucuccuucggaaucaaagaacacggcgacuucuaccccuucgacggaccaucaggccuacucgcccacgccuucccaccaggacccaacuacggaggcgacgcccacuucgaugacgacgaaaccuggaccuccuccuccaaaggcuacaaccucuuccuaguagccgcacacgaauuuggccacucacuaggacuagaccacuccaaagaccccggcgcucuuauguuccccaucuacaccuacacugggaaaucccacuucaugcuccccgacgacgacguacaaggcauccaaagccucuacggcccgggcgacgaagaucccaaccccaaacaccccaaaacaccagacaaaugcgaccccucacuaucacuagacgcaaucaccucccuccguggcgaaacuaugaucuucaaagaccgauucuucuggcgcuuacacccccaacaagucgacgccgaacucuuccuuaccaaaucauucuggcccgaacuccccaaccgcaucgacgccgccuacgaacaccccagccaugaccucaucuuuaucuuccgcgggagaaaauucugggcacuaaacggauacgacauacucgaaggcuacccaaaaaaaaucuccgaacuaggccucccaaaggaagucaaaaagaucuccgcagcaguacacuucgaagacaccggcaaaacccuccuauucucagguaaccaaguauggcgcuacgacgacaccaaccacaucauggacaaagacuacccccgccucaucgaagaagacuuccccggcauaggcgacaaagucgacgccgucuaugaaaaaaacggcuacauauacuucuuuaacggccccauccaauuugaauacuccauaugguccaaccgcaucguacgcguuaugccagccaacuccauccucuggugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5952 - RNA, 1371 nt, Artificial Sequence
  mRNA product Design5 comprising derived and/or modified sequence from Homo sapiens__NP_149126.1__HsPDGFD (opt11)
gggagagucccgcagucggcguccagcggcucugcuuguucgugugugugucguugcaggccuuauucaagcuuaccaugcaccgccuaaucuucgucuacacccuaaucugcgccaacuucugcuccugccgagacaccuccgccaccccacaauccgccuccauaaaagcacuccggaaugccaacuuacgccgggacgaccuauaccgucgagacgaaacaauccaaguaaaaggaaacggcuacgugcaaucgccccgauucccaaacuccuacccacgcaaccuccuccucaccuggcgacuacacucccaagaaaacacucgcauccaacucgucuucgacaaccaguucggccuggaagaagccgaaaacgacaucugccgcuacgacuucgucgaagucgaagacauaucagaaaccuccaccaucauacgcggccgcuggugcggccacaaagagguacccccccgcaucaaaucccgcacaaaccaaaucaaaauaaccuucaaaucagacgacuacuucguagcuaaacccggauucaaaaucuacuacucccuccuagaagacuuccaacccgccgcagcauccgagaccaacugggaauccguaaccuccuccauauccggcguauccuacaacagccccuccgucacagaccccacccuuauagccgacgcccucgacaaaaaaaucgccgaauuugacaccgucgaagaucuccuaaaauacuucaaccccgaaucauggcaagaagaccucgaaaacauguaccuagacaccccacgauaccgcggacgcucauaccacgaccgaaaauccaaagucgaccucgaccgacucaacgacgacgccaaacgcuacagcugcacaccacgcaacuacuccgucaacauccgcgaagaacuaaaacucgccaacguagucuucuucccccgcugccuucucguccaaagaugcggcggcaacugcggcuguggaaccguaaacuggcgcagcugcaccuguaacucaggcaaaaccgucaaaaaauaccacgaaguccuccaauucgaaccaggccacaucaaacgccgcggccgagccaaaacaauggcccucgucgacauccagcucgaccaccacgaacgcugcgacugcauaugcuccagccgccccccucgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5953 - RNA, 954 nt, Artificial Sequence
  mRNA product Design5 comprising derived and/or modified sequence from Homo sapiens__NP_003946.3__HsSOCS3 (opt11)
gggagagucccgcagucggcguccagcggcucugcuuguucgugugugugucguugcaggccuuauucaagcuuaccauggucacccacuccaaauucccugccgcaggcaugucccgaccccucgacaccucccuccgacucaaaaccuucuccucaaaguccgaauaccaacucgucgucaacgccguccguaaacuccaagaauccggcuucuacugguccgccgucaccgguggugaagcaaaccuccuccucuccgcagaacccgccggcaccuuccucauccgcgacuccucagaccaacgccacuucuucacccucucagucaaaacccaauccggcaccaaaaaccuccgcauccaaugcgaaggcggcuccuucucccuccaauccgacccacgcuccacacaaccugucccacgcuucgacugcguccucaaacucguccaccacuacaugccaccccccggcgcccccuccuucccauccccccccaccgaacccuccucagaaguccccgaacaacccucagcccaaccccuccccggcucccccccccgccgcgcauacuacaucuacuccggcggcgaaaaaaucccacucguacucucccgcccccucuccuccaacgucgccacccuacaacaccucugccgcaaaaccgucaacggccaccucgacuccuacgaaaaagucacccaacuacccggccccauccgcgaauuucucgaccaauacgaugcaccccuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5954 - RNA, 759 nt, Artificial Sequence
  mRNA product Design5 comprising derived and/or modified sequence from Homo sapiens__NP_003227.1__HsTGFA (opt11)
gggagagucccgcagucggcguccagcggcucugcuuguucgugugugugucguugcaggccuuauucaagcuuaccaugguccccuccgccggccaacucgcccuauucgcccucggaaucguccucgcagccugccaagcccucgaaaacuccaccuccccccucuccgccgacccccccgucgccgccgccgucgucucccacuucaacgacugccccgacucccacacccaauucugcuuccacggcaccugucgcuuccucguccaagaagacaaacccgccugcgucugccacuccggcuacgucggcgcccgcugcgaacacgccgaccuccucgccgucgucgccgccucccaaaaaaaacaagccaucaccgcccucgucgucgucuccaucgucgcccucgccguccucaucaucaccuguguccuaauccacugcugccaaguccgcaaacacugcgaauggugccgcgcccucaucugccgccacgaaaaacccuccgcccuccucaaaggccgcaccgccugcugccacuccgaaacagucguuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5955 - RNA, 1521 nt, Artificial Sequence
  mRNA product Design5 comprising derived and/or modified sequence from Homo sapiens__NP_003229.1__HsTGFB2 (opt11)
gggagagucccgcagucggcguccagcggcucugcuuguucgugugugugucguugcaggccuuauucaagcuuaccaugcacuacugcguccucuccgccuuccucauauuacaccucgucaccguugcccuaucccucucgacuugcuccacccucgacauggaccaauucaugcgcaaaagaaucgaagcaauccgaggccaaauccucucaaaacucaaacuuacaucccccccugaagacuauccagaacccgaggaaguccccccugaagucauauccauauacaacagcacccgcgaccuacuccaagaaaaagccucgcgacgagccgcagccugcgaacgcgaacgcagcgacgaagaauacuacgccaaggaagucuacaaaaucgacaugccgcccuucuucccaucagagaaugcuaucccccccaccuucuaccgaccauacuuccgcaucguccgcuucgacgucuccgcaauggaaaaaaacgccuccaaccucgucaaagccgaauuucgcgucuuccgccugcaaaaccccaaagcccgcguucccgaacaacgcaucgaacucuaccaaauacucaaauccaaagaccucaccucucccacccaacguuacaucgacucuaaaguagucaaaacacgcgccgaaggcgaauggcucuccuucgacguaaccgacgccguacacgaauggcuccaccacaaagacagaaaccucggauucaaaaucucccuacacugccccugcugcacuuucguccccuccaacaacuacauaauucccaacaaauccgaagaacuugaagcccgcuucgccggcaucgacggaaccucgaccuacacuucaggcgaccagaaaaccauuaaauccacccgcaaaaaaaacucgggcaaaacaccccaccuccuacucaugcuccucccauccuaccggcuagaaucccaacaaaccaaccgacgcaaaaaacgagcccucgacgcagccuacugcuuccguaacguccaagacaauugcugccuacgcccacucuacaucgauuucaaacgugaccucggauggaaauggauccaugaacccaaaggcuacaacgccaacuucugcgcaggcgcaugccccuaccucuggagcuccgacacccaacacucccgcguccuaagccuuuacaacaccaucaaccccgaagccucagccucccccugcugcgucucccaagaccucgaaccacuaacaauccucuacuacaucggcaaaacccccaaaauagaacaacucuccaacaugaucgucaaauccugcaaaugcuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5956 - RNA, 1662 nt, Artificial Sequence
  mRNA product Design5 comprising derived and/or modified sequence from Homo sapiens__NP_001057.1__HsTNFRSF1B (opt11)
gggagagucccgcagucggcguccagcggcucugcuuguucgugugugugucguugcaggccuuauucaagcuuaccauggcaccagucgcagucugggccgcccucgccguaggccuugaacucugggcagccgcccacgcccucccagcacaagucgcauucacucccuacgcacccgaacccggcuccaccugucgccuacgcgaauacuaugaccaaacagcacaaaugugcugcuccaaaugcucucccggccaacacgcuaaaguauucugcacaaaaaccucugacaccguaugcgacucaugcgaagacuccacauauacccaacucuggaacuggguccccgaaugccucuccugcggcucccgcugcagcucagaccaaguagaaacccaagcaugcacccgcgagcaaaaccgcaucugcacaugccgccccggcugguacugcgcucucuccaaacaagaaggcugcagacuuugugcaccucugaggaaaugccgaccaggcuuugguguagcaagacccgguaccgaaaccucagacgucgucugcaaaccgugugcacccggcaccuucucaaacaccaccuccucuaccgacaucugccgaccacaucaaaucugcaacguagucgccaucccaggcaacgccuccauggacgccguaugcaccucgaccucccccacccgcuccauggcccccggcgccguacaccuaccccaacccgucuccacccgaucccagcacacccaacccaccccagaacccagcaccgccccgucaaccucauuccuacucccaaugggccccuccccacccgcagaaggcuccacaggcgauuucgcccuccccguaggacuaauaguuggcgucaccgcccuaggccuccuuaucaucggcguagucaacugcgucaucaugacccaagucaaaaaaaaaccccucugccuccaacgcgaagccaaagucccacaccucccagccgacaaagcccgcggaacccaaggccccgaacaacaacaccuccucaucaccgcccccucaucaagcuccuccucacucgaaucauccgccuccgcccucgaucgacgcgcccccacacgcaaccaaccacaagccccaggcguagaagcguccggcgccggcgaagcccgcgccuccaccggcucguccgacuccucaccaggaggucacggcacccaaguaaaugucaccuguaucgugaacguuuguuccuccucagaucacagcucccaauguucuucccaagccuccuccacaaugggcgacaccgauuccagccccucagaaucccccaaagacgaacaagucccauucucaaaagaagagugugccuuccgaucccagcucgaaacaccagaaacccuacucgguucaaccgaagaaaaaccccucccccucggcgucccagacgcaggcaugaaacccuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5957 - RNA, 975 nt, Artificial Sequence
  mRNA product Design5 comprising derived and/or modified sequence from Homo sapiens__NP_001165094.1__HsVEGFA (opt11)
gggagagucccgcagucggcguccagcggcucugcuuguucgugugugugucguugcaggccuuauucaagcuuaccaugaacuuccuccuaagcuggguccacuggucccucgcccuacuccucuaccuacaccacgccaaauggucccaagccgcacccauggccgaaggcggcggccaaaaccaccacgaagucgucaaauucauggacgucuaccaacgcucauacugccaccccaucgaaacccucgucgacaucuuccaagaauaccccgacgaaauagaauacaucuucaaacccucaugcgucccccucaugcgcugcggcggcugcugcaacgacgaaggacucgaaugcguacccaccgaagaaucaaacaucacaaugcaaaucaugcgcaucaaaccccaccaaggccaacacaucggcgaaauguccuuccuccaacacaacaaaugcgaaugccgccccaaaaaagaccgagcacgacaagaaaaaaaauccguccgaggcaaaggcaaaggccaaaaacgaaaaagaaaaaaaucccgcuacaaauccugguccguauacgucggcgcccgaugcugccucaugccauggucccuccccggcccccacccaugcggccccugcuccgaacgccgcaaacaccucuucguccaagacccccaaaccugcaaaugcuccugcaaaaacaccgacuccagaugcaaagcccgccaacucgaacucaacgaacgcaccugucgcugcgacaaaccccgacgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5958 - RNA, 900 nt, Artificial Sequence
  mRNA product Design5 comprising derived and/or modified sequence from Homo sapiens__NP_003368.1__HsVEGFB (opt11)
gggagagucccgcagucggcguccagcggcucugcuuguucgugugugugucguugcaggccuuauucaagcuuaccauguccccccuccuccgccgccuccuccucgcagcccuacuccaacuagcccccgcacaagcccccgucucccaacccgacgcccccggccaccaacgcaaaguagucuccuggauagacgucuacacccgcgccaccugucaaccccgcgaagucguagucccccucacagucgaacucaugggcacagucgccaaacaacucguacccucaugcgucaccguccaaagaugcggcggcugcugccccgacgacggccucgaaugcguccccaccggccaacaccaaguccgcaugcaaauacucaugauccgauacccaucaucccaacuaggagaaaugucacucgaagaacacucucaaugcgaaugcagacccaaaaaaaaagacucagccguaaaaccagaccgcgccgcaacaccccaccaccgcccccaaccacgaucaguccccggcugggacuccgcccccggcgcccccucccccgccgacaucacccaccccacccccgcccccggcccauccgcccacgccgcccccuccaccaccucugcccuaacccccggccccgccgccgccgccgcagacgccgccgccucauccgucgccaaaggcggcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5959 - RNA, 534 nt, Artificial Sequence
  derived and/or modified CDS sequence (wt) from Sus scrofa__P45561-2__SsAMELX-001-2
auggggaccuggauuuuguuugcuugccuccugggagcagccuucucuaugccucuaccaccucauccugggcacccugguuauaucaacuucagcuauauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaa

SEQ ID NO: 5960 - RNA, 570 nt, Artificial Sequence
  derived and/or modified CDS sequence (wt) from Sus scrofa__NP_998965.1__SsAMELX-001-3
auggggaccuggauuuucuuugccugccuuuugggagcaucccuugcuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaa

SEQ ID NO: 5961 - RNA, 219 nt, Artificial Sequence
  derived and/or modified CDS sequence (wt) from Sus scrofa__K7GPB2__SsAMELX-002
auggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaa

SEQ ID NO: 5962 - RNA, 612 nt, Artificial Sequence
  derived and/or modified CDS sequence (wt) from Sus scrofa__K7GLD0__SsAMELX-003
auggggaccuggauuuuguuugcuugccuccugggagcagccuucucuaugccucuaccaccucauccugggcacccugguuauaucaacuucagcuaugaggacuuauacuuggaggcuauccguauugacaggacugcauucgugcuuaccccucugaagugguaccagaacaugauaagacauccguacacuuccuaugguuacgaacccauggguggauggcugcaccaccaaaucauucccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaa

SEQ ID NO: 5963 - RNA, 498 nt, Artificial Sequence
  derived and/or modified CDS sequence (wt) from Sus scrofa__K7GPE9__SsAMELX-004
auggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaa

SEQ ID NO: 5964 - RNA, 522 nt, Artificial Sequence
  derived and/or modified CDS sequence (wt) from Sus scrofa__J9JIM4__SsAMELX-201
augccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaa

SEQ ID NO: 5965 - RNA, 2961 nt, Artificial Sequence
  derived and/or modified CDS sequence (wt) from Homo sapiens__NP_006120.1__HsBMP1
augcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcggcugccuuucuuggggacauugcccuggacgaagaggaccugagggccuuccagguacagcaggcuguggaucucagacggcacacagcucguaaguccuccaucaaagcugcaguuccaggaaacacuucuacccccagcugccagagcaccaacgggcagccucagaggggagccugugggagauggagagguagaucccguagccggcgggcggcgacgucccgaccagagcguguguggcccgauggggucauccccuuugucauugggggaaacuucacugguagccagagggcagucuuccggcaggccaugaggcacugggagaagcacaccugugucaccuuccuggagcgcacugacgaggacagcuauauuguguucaccuaucgaccuugcgggugcugcuccuacgugggucgccgcggcgggggcccccaggccaucuccaucggcaagaacugugacaaguucggcauugugguccacgagcugggccacgucgucggcuucuggcacgaacacacucggccagaccgggaccgccacguuuccaucguucgugagaacauccagccagggcaggaguauaacuuccugaagauggagccucaggagguggagucccugggggagaccuaugacuucgacagcaucaugcauuacgcucggaacacauucuccaggggcaucuuccuggauaccauuguccccaaguaugaggugaacggggugaaaccucccauuggccaaaggacacggcucagcaagggggacauugcccaagcccgcaagcuguacaagugcccagccuguggagagacccugcaagacagcacaggcaacuucuccuccccugaauaccccaauggcuacucugcucacaugcacugcguguggcgcaucucugucacacccggggagaagaucauccugaacuucacgucccuggaccuguaccgcagccgccugugcugguacgacuauguggagguccgagauggcuucuggaggaaggcgccccuccgaggccgcuucugcggguccaaacucccugagccuaucgucuccacugacagccgccucuggguugaguuccgcagcagcagcaauuggguuggaaagggcuucuuugcagucuacgaagccaucugcgggggugaugugaaaaaggacuauggccacauucaaucgcccaacuacccagacgauuaccggcccagcaaagucugcaucuggcggauccaggugucugagggcuuccacgugggccucacauuccaguccuuugagauugagcgccacgacagcugugccuacgacuaucuggaggugcgcgacgggcacagugagagcagcacccucaucgggcgcuacuguggcuaugagaagccugaugacaucaagagcacguccagccgccucuggcucaaguucgucucugacggguccauuaacaaagcgggcuuugccgucaacuuuuucaaagagguggacgagugcucucggcccaaccgcgggggcugugagcagcggugccucaacacccugggcagcuacaagugcagcugugaccccggguacgagcuggccccagacaagcgccgcugugaggcugcuuguggcggauuccucaccaagcucaacggcuccaucaccagcccgggcuggcccaaggaguacccccccaacaagaacugcaucuggcagcugguggcccccacccaguaccgcaucucccugcaguuugacuucuuugagacagagggcaaugaugugugcaaguacgacuucguggaggugcgcaguggacucacagcugacuccaagcugcauggcaaguucugugguucugagaagcccgaggucaucaccucccaguacaacaacaugcgcguggaguucaaguccgacaacaccguguccaaaaagggcuucaaggcccacuucuucucagacaaggacgagugcuccaaggauaacggcggcugccagcaggacugcgucaacacguucggcaguuaugagugccaaugccgcaguggcuucguccuccaugacaacaagcacgacugcaaagaagccggcugugaccacaaggugacauccaccagugguaccaucaccagccccaacuggccugacaaguaucccagcaagaaggagugcacgugggccaucuccagcacccccgggcaccgggucaagcugaccuucauggagauggacaucgagucccagccugagugugccuacgaccaccuagagguguucgacgggcgagacgccaaggcccccguccucggccgcuucugugggagcaagaagcccgagcccguccuggccacaggcagccgcauguuccugcgcuucuacucagauaacucgguccagcgaaagggcuuccaggccucccacgccacagagugcgggggccagguacgggcagacgugaagaccaaggaccuuuacucccacgcccaguuuggcgacaacaacuacccuggggguguggacugugagugggucauuguggccgaggaaggcuacggcguggagcucguguuccagaccuuugagguggaggaggagaccgacugcggcuaugacuacauggagcuguucgacggcuacgacagcacagcccccaggcuggggcgcuacuguggcucagggccuccugaggagguguacucggcgggagauucuguccuggugaaguuccacucggaugacaccaucaccaaaaaagguuuccaccuccgauacaccagcaccaaguuccaggacacacuccacagcaggaaguga

SEQ ID NO: 5966 - RNA, 1191 nt, Artificial Sequence
  derived and/or modified CDS sequence (wt) from Homo sapiens__NP_001191.1__HsBMP2
augguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcagaugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuag

SEQ ID NO: 5967 - RNA, 1227 nt, Artificial Sequence
  derived and/or modified CDS sequence (wt) from Homo sapiens__NP_001193.2__HsBMP4
augauuccugguaaccgaaugcugauggucguuuuauuaugccaaguccugcuaggaggcgcgagccaugcuaguuugauaccugagacggggaagaaaaaagucgccgagauucagggccacgcgggaggacgccgcucagggcagagccaugagcuccugcgggacuucgaggcgacacuucugcagauguuugggcugcgccgccgcccgcagccuagcaagagugccgucauuccggacuacaugcgggaucuuuaccggcuucagucuggggaggaggaggaagaacagauccacagcacuggucuugaguauccugagcgcccggccagccgggccaacaccgugaggagcuuccaccacgaagaacaucuggagaacaucccagggaccagugaaaacucugcuuuucguuuccucuuuaaccucagcagcaucccugagaacgaggugaucuccucugcagagcuucggcuguuccgggagcaggucgaccagggcccugauugggaaaggggcuuccaccguauaaacauuuaugagguuaugaagcccccagcagaaguggugccugggcaccucaucacacgacuacuggacacgagacugguccaccacaaugugacacggugggaaacuuuugaugugagcccugcgguccuucgcuggacccgggagaagcagccaaacuaugggcuagccauugaggugacucaccuccaucagacucggacccaccagggccagcaugucaggauuagccgaucguuaccucaagggagugggaauugggcccagcuccggccccuccuggucaccuuuggccaugauggccggggccaugccuugacccgacgccggagggccaagcguagcccuaagcaucacucacagcgggccaggaagaagaauaagaacugccggcgccacucgcucuauguggacuucagcgaugugggcuggaaugacuggauuguggccccaccaggcuaccaggccuucuacugccauggggacugccccuuuccacuggcugaccaccucaacucaaccaaccaugccauugugcagacccuggucaauucugucaauuccaguauccccaaagccuguugugugcccacugaacugagugccaucuccaugcuguaccuggaugaguaugauaaggugguacugaaaaauuaucaggagaugguaguagagggaugugggugccgcuga

SEQ ID NO: 5968 - RNA, 1542 nt, Artificial Sequence
  derived and/or modified CDS sequence (wt) from Homo sapiens__NP_001709.1__HsBMP6
augccggggcuggggcggagggcgcaguggcugugcugguggugggggcugcugugcagcugcugcgggcccccgccgcugcggccgcccuugcccgcugccgcggccgccgccgccggggggcagcugcugggggacggcgggagccccggccgcacggagcagccgccgccgucgccgcaguccuccucgggcuuccuguaccggcggcucaagacgcaggagaagcgggagaugcagaaggagaucuugucggugcuggggcucccgcaccggccccggccccugcacggccuccaacagccgcagcccccggcgcuccggcagcaggaggagcagcagcagcagcagcagcugccucgcggagagcccccucccgggcgacugaaguccgcgccccucuucaugcuggaucuguacaacgcccuguccgccgacaacgacgaggacggggcgucggagggggagaggcagcaguccuggccccacgaagcagccagcucgucccagcgucggcagccgcccccgggcgccgcgcacccgcucaaccgcaagagccuucuggcccccggaucuggcagcggcggcgcguccccacugaccagcgcgcaggacagcgccuuccucaacgacgcggacauggucaugagcuuugugaaccugguggaguacgacaaggaguucuccccucgucagcgacaccacaaagaguucaaguucaacuuaucccagauuccugagggugagguggugacggcugcagaguuccgcaucuacaaggacuguguuauggggaguuuuaaaaaccaaacuuuucuuaucagcauuuaucaagucuuacaggagcaucagcacagagacucugaccuguuuuuguuggacacccguguaguaugggccucagaagaaggcuggcuggaauuugacaucacggccacuagcaaucuguggguugugacuccacagcauaacauggggcuucagcugagcguggugacaagggauggaguccacguccacccccgagccgcaggccuggugggcagagacggcccuuacgacaagcagcccuucaugguggcuuucuucaaagugagugaggugcacgugcgcaccaccaggucagccuccagccggcgccgacaacagagucguaaucgcucuacccagucccaggacguggcgcgggucuccagugcuucagauuacaacagcagugaauugaaaacagccugcaggaagcaugagcuguaugugaguuuccaagaccugggauggcaggacuggaucauugcacccaagggcuaugcugccaauuacugugauggagaaugcuccuucccacucaacgcacacaugaaugcaaccaaccacgcgauugugcagaccuugguucaccuuaugaaccccgaguauguccccaaaccgugcugugcgccaacuaagcuaaaugccaucucgguucuuuacuuugaugacaacuccaaugucauucugaaaaaauacaggaauaugguuguaagagcuuguggaugccacuaa

SEQ ID NO: 5969 - RNA, 1296 nt, Artificial Sequence
  derived and/or modified CDS sequence (wt) from Homo sapiens__NP_001710.1__HsBMP7
augcacgugcgcucacugcgagcugcggcgccgcacagcuucguggcgcucugggcaccccuguuccugcugcgcuccgcccuggccgacuucagccuggacaacgaggugcacucgagcuucauccaccggcgccuccgcagccaggagcggcgggagaugcagcgcgagauccucuccauuuugggcuugccccaccgcccgcgcccgcaccuccagggcaagcacaacucggcacccauguucaugcuggaccuguacaacgccauggcgguggaggagggcggcgggcccggcggccagggcuucuccuaccccuacaaggccgucuucaguacccagggccccccucuggccagccugcaagauagccauuuccucaccgacgccgacauggucaugagcuucgucaaccucguggaacaugacaaggaguucuuccacccacgcuaccaccaucgagaguuccgguuugaucuuuccaagaucccagaaggggaagcugucacggcagccgaguuccggaucuacaaggacuacauccgggaacgcuucgacaaugagacguuccggaucagcguuuaucaggugcuccaggagcacuugggcagggaaucggaucucuuccugcucgacagccguacccucugggccucggaggagggcuggcugguguuugacaucacagccaccagcaaccacuggguggucaauccgcggcacaaccugggccugcagcucucgguggagacgcuggaugggcagagcaucaaccccaaguuggcgggccugauugggcggcacgggccccagaacaagcagcccuucaugguggcuuucuucaaggccacggagguccacuuccgcagcauccgguccacggggagcaaacagcgcagccagaaccgcuccaagacgcccaagaaccaggaagcccugcggauggccaacguggcagagaacagcagcagcgaccagaggcaggccuguaagaagcacgagcuguaugucagcuuccgagaccugggcuggcaggacuggaucaucgcgccugaaggcuacgccgccuacuacugugagggggagugugccuucccucugaacuccuacaugaacgccaccaaccacgccaucgugcagacgcugguccacuucaucaacccggaaacggugcccaagcccugcugugcgcccacgcagcucaaugccaucuccguccucuacuucgaugacagcuccaacgucauccugaagaaauacagaaacauggugguccgggccuguggcugccacuag

SEQ ID NO: 5970 - RNA, 300 nt, Artificial Sequence
  derived and/or modified CDS sequence (wt) from Homo sapiens__NP_006264.2__HsCCL7
augaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcuguga

SEQ ID NO: 5971 - RNA, 3624 nt, Artificial Sequence
  derived and/or modified CDS sequence (wt) from Homo sapiens__NP_001954.2__HsEGF
augcugcucacucuuaucauucuguugccaguaguuucaaaauuuaguuuuguuagucucucagcaccgcagcacuggagcuguccugaagguacucucgcaggaaauggcaauucuacuuguguggguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccugagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcaggaggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcggagcuuucauaugcccuccuaugggacacagacccuugaagggggugucgagaagccccauucucuccuaucagcuaacccauuauggcaacaaagggcccuggacccaccacaccaaauggagcugacucaguga

SEQ ID NO: 5972 - RNA, 510 nt, Artificial Sequence
  derived and/or modified CDS sequence (wt) from Homo sapiens__NP_001423.1__HsEREG
augaccgcggggaggaggauggagaugcucugugccggcagggucccugcgcugcugcucugccuggguuuccaucuucuacaggcaguccucaguacaacugugauuccaucauguaucccaggagaguccagugauaacugcacagcuuuaguucagacagaagacaauccacguguggcucaagugucaauaacaaaguguagcucugacaugaauggcuauuguuugcauggacagugcaucuaucugguggacaugagucaaaacuacugcagaugugaaguggguuauacugguguccgaugugaacacuucuuuuuaaccguccaccaaccuuuaagcaaagaauauguggcuuugaccgugauucuuauuauuuuguuucuuaucacagucgucgguuccacauauuauuucugcagaugguacagaaaucgaaaaaguaaagaaccaaagaaggaauaugagagaguuaccucaggggauccagaguugccgcaagucuga

SEQ ID NO: 5973 - RNA, 867 nt, Artificial Sequence
  derived and/or modified CDS sequence (wt) from Homo sapiens__NP_001997.5__HsFGF2
auggugggugugggggguggagauguagaagaugugacgccgcggcccggcgggugccagauuagcggacgcggugcccgcgguugcaacgggaucccgggcgcugcagcuugggaggcggcucuccccaggcggcguccgcggagacacccauccgugaaccccaggucccgggccgccggcucgccgcgcaccaggggccggcggacagaagaacggccgagcggcucgaggcugggggaccgcgggcgcggccgcgcgcugccgggcgggaggcuggggggccggggccggggccgugccccggagcgggucggaggccggggccggggccgggggacggcggcuccccgcgcggcuccagcggcucggggaucccggccgggccccgcagggaccauggcagccgggagcaucaccacgcugcccgccuugcccgaggauggcggcagcggcgccuucccgcccggccacuucaaggaccccaagcggcuguacugcaaaaacgggggcuucuuccugcgcauccaccccgacggccgaguugacgggguccgggaaaagagcgacccucacaucaagcuacaacuucaagcagaagagagaggaguugugucuaucaaaggagugugugcuaaccguuaccuggcuaugaaggaagauggaagauuacuggcuucuaaauguguuacggaugaguguuucuuuuuugaacgauuggaaucuaauaacuacaauacuuaccggucaaggaaauacaccaguugguauguggcacugaaacgaacugggcaguauaaacuuggauccaaaacaggaccugggcagaaagcuauacuuuuucuuccaaugucugcuaagagcuga

SEQ ID NO: 5974 - RNA, 585 nt, Artificial Sequence
  derived and/or modified CDS sequence (wt) from Homo sapiens__NP_002000.1__HsFGF7
augcacaaauggauacugacauggauccugccaacuuugcucuacagaucaugcuuucacauuaucugucuaguggguacuauaucuuuagcuugcaaugacaugacuccagagcaaauggcuacaaaugugaacuguuccagcccugagcgacacacaagaaguuaugauuacauggaaggaggggauauaagagugagaagacucuucugucgaacacagugguaccugaggaucgauaaaagaggcaaaguaaaagggacccaagagaugaagaauaauuacaauaucauggaaaucaggacaguggcaguuggaauuguggcaaucaaagggguggaaagugaguucuaucuugcaaugaacaaggaaggaaaacucuaugcaaagaaagaaugcaaugaagauuguaacuucaaagaacuaauucuggaaaaccauuacaacacauaugcaucagcuaaauggacacacaacggaggggaaauguuuguugccuuaaaucaaaaggggauuccuguaagaggaaaaaaaacgaagaaagaacaaaaaacagcccacuuucuuccuauggcaauaacuuaa

SEQ ID NO: 5975 - RNA, 2187 nt, Artificial Sequence
  derived and/or modified CDS sequence (wt) from Homo sapiens__NP_000592.3__HsHGF
augugggugaccaaacuccugccagcccugcugcugcagcauguccuccugcaucuccuccugcuccccaucgccauccccuaugcagagggacaaaggaaaagaagaaauacaauucaugaguucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaaucccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcauggcuuggaauccaugauguccacggaagaggagaugagaaaugcaaacagguucucaauguuucccagcugguauauggcccugaaggaucagaucugguuuuaaugaagcuggccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauag

SEQ ID NO: 5976 - RNA, 1926 nt, Artificial Sequence
  derived and/or modified CDS sequence (wt) from Homo sapiens__NP_005336.3 __HsHSPA1A
auggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggucagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaaaagcgccguggaggaugaggggcucaagggcaagaucagcgaggcggacaagaagaaggugcuggacaagugucaagaggucaucucguggcuggacgccaacaccuuggccgagaaggacgaguuugagcacaagaggaaggagcuggagcaggucuguaaccccaucaucagcggacuguaccagggugccgguggucccgggccugggggcuucggggcucagggucccaagggagggucugggucaggccccaccauugaggagguagauuag

SEQ ID NO: 5977 - RNA, 1926 nt, Artificial Sequence
  derived and/or modified CDS sequence (wt) from Homo sapiens__NP_005337.2 __HsHSPA1B
auggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggucagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaaaagcgccguggaggaugaggggcucaagggcaagaucagcgaggcggacaagaagaagguucuggacaagugucaagaggucaucucguggcuggacgccaacaccuuggccgagaaggacgaguuugagcacaagaggaaggagcuggagcaggucuguaaccccaucaucagcggacuguaccagggugccgguggucccgggccuggcggcuucggggcucagggucccaagggagggucugggucaggcccuaccauugaggagguggauuag

SEQ ID NO: 5978 - RNA, 1926 nt, Artificial Sequence
  derived and/or modified CDS sequence (wt) from Homo sapiens__NP_005518.3 __HsHSPA1L
auggcuacugccaagggaaucgccauaggcaucgaccugggcaccaccuacuccuguguggggguguuccagcacggcaagguggagaucaucgccaacgaccagggcaaccgcaccacccccagcuacguggccuucacagacaccgagcggcucauuggggaugcggccaagaaccagguagcaaugaauccccagaacacuguuuuugaugcuaaacgucugaucggcaggaaauuuaaugauccuguuguacaagcagauaugaaacuuuggccuuuucaagugauuaaugaaggaggcaagcccaaaguccuuguguccuacaaaggggagaauaaagcauucuacccugaggaaaucucuucgaugguauugacuaaguugaaggagacugcugaggccuuuuugggccacccugucaccaaugcagugauuaccgugccagccuauuucaaugacucucaacgucaggcuacuaaggaugcaggagugauugcuggacuuaaugugcuaagaaucaucaaugagcccacggcugcugccauugccuaugguuuagauaaaggaggucaaggagaacgacauguccugauuuuugaucuggguggaggcacauuugaugugucaauucugaccauagaugaugggauuuuugagguaaaggccacugcuggggacacucaccuggguggggaggacuuugacaacaggcuugugagccacuucguggaggaguucaagaggaaacacaaaaaggacaucagccagaacaagcgagccgugaggcggcugcgcaccgccugcgagagggccaagaggacccugucguccagcacccaggccaaccuagaaauugauucacuuuaugaaggcauugacuucuauacauccaucaccagagcucgauuugaagaguugugugcagaccuguuuagggguacccuggagccuguagaaaaagcgcuucgggaugccaagauggauaaggcuaaaauccaugacauuguuuuaguagggggcuccacccgcauccccaaggugcagcggcugcuucaggacuacuucaauggacgugaucucaacaagagcaucaacccugaugaggccguagcauauggggcugcgguacaagcagccauccugaugggggacaagucugagaagguacaggaccugcugcugcuggacguggcuccccugucccuggggcuggagacggcugggggcgugaugacugcccugauaaagcgcaacuccaccauccccaccaagcagacacagauuuucaccaccuacucugacaaccaacccggggugcugauccagguguaugagggcgagagggccaugacaaaggacaacaaccugcuggggcgguuugaccugacuggaaucccuccagcacccaggggaguuccucagaucgaggugacguuugacauugaugccaaugguauucucaaugucacagccacggacaagagcaccggcaaggugaacaagaucaccaucaccaaugacaagggccgccugagcaaggaggagauugagcgcaugguucuggaugcugagaaauauaaagcugaagaugagguccagagggagaaaauugcugcaaagaaugccuuagaauccuaugcuuuuaacaugaagaguguugugagugaugaagguuugaagggcaagauuagugagucugauaaaaauaaaauauuggauaaaugcaacgagcuccuuucguggcuggaggucaaucaacuggcagagaaagaugaguuugaucauaagagaaaggaauuggagcagauguguaacccuaucaucacaaaacucuaccaaggaggaugcacugggccugccugcggaacaggguaugugccuggaaggccugccacaggccccacaauugaagaaguagauuaa

SEQ ID NO: 5979 - RNA, 2523 nt, Artificial Sequence
  derived and/or modified CDS sequence (wt) from Homo sapiens__NP_002145.3 __HsHSPA4
augucgguggugggcauagaccugggcuuccagagcugcuacgucgcuguggcccgcgccggcggcaucgagacuaucgcuaaugaguauagcgaccgcugcacgccggcuugcauuucuuuugguccuaagaaucguucaauuggagcagcagcuaaaagccagguaauuucuaaugcaaagaacacaguccaaggauuuaaaagauuccauggccgagcauucucugauccauuuguggaggcagaaaaaucuaaccuugcauaugauauugugcaguugccuacaggauuaacagguauaaaggugacauauauggaggaagaacgaaauuuuaccacugagcaagugacugccaugcuuuuguccaaacugaaggagacagccgaaaguguucuuaagaagccuguaguugacuguguuguuucgguuccuuguuucuauacugaugcagaaagacgaucagugauggaugcaacacagauugcuggucuuaauugcuugcgauuaaugaaugaaaccacugcaguugcucuugcauauggaaucuauaagcaggaucuuccugccuuagaagagaaaccaagaaauguaguuuuuguagacaugggccacucugcuuaucaaguuucuguaugugcauuuaauagaggaaaacugaaaguucuggccacugcauuugacacgacauugggagguagaaaauuugaugaaguguuaguaaaucacuucugugaagaauuugggaagaaauacaagcuagacauuaaguccaaaauccgugcauuauuacgacucucucaggagugugagaaacucaagaaauugaugagugcaaaugcuucagaucucccuuugagcauugaauguuuuaugaaugauguugauguaucuggaacuaugaauagaggcaaauuucuggagaugugcaaugaucucuuagcuagaguggagccaccacuucguaguguuuuggaacaaaccaaguuaaagaaagaagauauuuaugcaguggagauaguugguggugcuacacgaaucccugcgguaaaagagaagaucagcaaauuuuucgguaaagaacuuaguacaacauuaaaugcugaugaagcugucacucgaggcugugcauugcagugugccaucuuaucgccugcuuucaaagucagagaauuuucuaucacugauguaguaccauauccaauaucucugagauggaacucuccagcugaagaagggucaagugacugugaagucuuuuccaaaaaucaugcugcuccuuucucuaaaguucuuacauuuuauagaaaggaaccuuucacucuugaggccuacuacagcucuccucaggauuugcccuauccagauccugcuauagcucaguuuucaguucagaaagucacuccucagucugauggcuccaguucaaaagugaaagucaaaguucgaguaaauguccauggcauuuucaguguguccagugcaucuuuaguggagguucacaagucugaggaaaaugaggagccaauggaaacagaucagaaugcaaaggaggaagagaagaugcaaguggaccaggaggaaccacauguugaagaacaacagcagcagacaccagcagaaaauaaggcagagucugaagaaauggagaccucucaagcuggauccaaggauaaaaagauggaccaaccaccccaagccaagaaggcaaaagugaagaccaguacuguggaccugccaaucgagaaucagcuauuauggcagauagacagagagaugcucaacuuguacauugaaaaugaggguaagaugaucaugcaggauaaacuggagaaggagcggaaugaugcuaagaacgcaguggaggaauauguguaugaaaugagagacaagcugaguggugaauaugagaaguuugugagugaagaugaucguaacaguuuuacuuugaaacuggaagauacugaaaauugguuguaugaggauggagaagaccagccaaagcaaguuuauguugauaaguuggcugaauuaaaaaaucuaggucaaccuauuaagauacguuuccaggaaucugaagaacgaccaaaauuauuugaagaacuagggaaacagauccaacaguauaugaaaauaaucagcucuuucaaaaacaaggaggaccaguaugaucauuuggaugcugcugacaugacaaagguagaaaaaagcacaaaugaagcaauggaguggaugaauaacaagcuaaaucugcagaacaagcagaguuugaccauggauccaguugucaagucaaaagagauugaagcuaaaauuaaggagcugacaaguacuuguagcccuauaauuucaaagcccaaacccaaaguggaaccuccaaaagaggaacaaaaaaaugcagagcagaauggaccaguggauggacaaggagacaacccaggcccccaggcugcugagcaggguacagacacagcugugccuucggauucagacaagaagcugccugaaauggacauugauuga

SEQ ID NO: 5980 - RNA, 2520 nt, Artificial Sequence
  derived and/or modified CDS sequence (wt) from Homo sapiens__NP_055093.2 __HsHSPA4L
augucugugguuggcauugaccucggcuuucucaacugcuacauugcugucgcgagaaguggcggcaucgagaccaucgccaaugaguacagcgacagguguaccccggccuguauaucauugggaucaagaacucgagccauuggaaaugcagcaaagagccagauagucacgaacguaagaaauacaauucauggcuucaaaaagcugcaugggcgaucauuugaugaucccauugugcaaacugaaaggaucaggcuucccuaugaacugcagaaaaugccuaauggaagugcaggaguuaaggugcgguacuuagaggaagagagaccuuuugcaauugagcaaguuacuggaaugcuguuagccaagcugaaagagacuucagaaaaugcuuugaagaaaccaguggcugacugugugauuucaauuccuagcuuuuuuacugaugccgagagaagaucugugauggcugcagcccagguugcaggcuuaaauuguuuaagguugaugaaugaaacuacugcaguugcacuggcguauggaauuuauaaacaggaucuucccccauuagaugagaaaccaagaaauguaguauuuauugauaugggacauucugccuaucaggucuugguuugugcuuuuaacaaaggaaaacuuaaagucuuggcuacuaccuuugauccauauuuggguggcaggaacuuugaugaggcuuuaguagacuacuucugugaugaguucaagaccaaauauaagauaaaugugaaagaaaacucucgggccuuguugcguuuauaucaggaaugugaaaaacuaaagaagcuaaugagugcaaaugcaucagaucuuccauugaacauugaguguuucaugaaugaccuugauguuucuaguaaaaugaacagggcucaauuugaacaacugugugcuucccuuuuggccaggguugaaccaccuuuaaaagcaguaauggaacaagcuaacuuacaacgugaagacauuaguaguauagaaauuguaggaggagcaacacgaaucccugcagugaaagaacaaaucacuaaauucuuucuuaaagacauaaguaccacauuaaaugcugaugaagcuguugcaagaggaugugcguuacagugugcgauucucucaccagcauuuaaagugcgugaauuuuccauaacagaccuuguucccuauucaaucacauuaagguggaagaccucuuuugaagauggaaguggggaaugugaaguuuucuguaagaaccauccugccccauucucaaaagucauuacuuuccacaagaaggaaccauuugaacuagaagcauuuuauacuaauuuacaugaagugccuuauccugaugcaagaauugggagcuucacuauucagaauguuuuuccacagucugauggugauaguuccaaagugaagguuaaaguucguguuaacauccauggaaucuucaguguggcuagcgcaucaguaauugagaagcaaaauuuggaaggcgaucacagugaugcuccaauggagacagaaacuucauuuaaaaaugaaaacaaagauaauauggauaaaaugcagguugaucaagaagaagggcaucaaaaaugucaugcugaacacacuccagaagaggaaauugaucauacaggagccaaaacaaagucagcugucucagacaaacaagaccgauuaaaucagacacuuaaaaaaggaaaagucaaaaguauugaucuaccgauccagaguagccuauguagacaacuaggccaagaucuucucaacagcuacauugaaaaugaggggaagaugaucaugcaagauaaguuagagaaagaaagaaaugaugcuaagaaugccguugaagaauauguauaugauuuuagagacaggcugggcacugucuaugaaaaauucaucacuccagaagacuugaguaaacugucugcaguauuggaagacacagaaaauuggcuuuaugaagacggagaggaccaaccuaaacaaguuuauguggauaagcugcaagaacuaaagaaauacggccagccuauucaaaugaaguacauggagcaugaagagagaccaaaagccuuaaaugacuugggaaaaaagauccaacuugucaugaaagugauagaagcauauagaaacaaggaugaaagauaugaucaucuggauccuacugaaauggaaaagguugaaaaauguaucagugaugccaugaguuggcugaauaguaagaugaaugcacagaacaaacuaagucucacucaagauccugugguaaaaguuucagaaauaguagcaaagucaaaggaacuggauaauuucuguaaccccaucauuuacaagcccaaaccaaaagcagaaguuccugaagacaaaccaaaagcuaauagugaacacaauggcccaauggauggacagaguggaacugaaacuaaaucagauucaacaaaagacagcucacagcauacuaaauccucuggagagauggaaguggacuaa

SEQ ID NO: 5981 - RNA, 1965 nt, Artificial Sequence
  derived and/or modified CDS sequence (wt) from Homo sapiens__NP_005338.1__HsHSPA5
augaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagaacucaacauggaucuguuccggucuacuaugaagcccguccagaaaguguuggaagauucugauuugaagaagucugauauugaugaaauuguucuuguugguggcucgacucgaaucccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaaucccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguag

SEQ ID NO: 5982 - RNA, 1932 nt, Artificial Sequence
  derived and/or modified CDS sequence (wt) from Homo sapiens__NP_002146.2__HsHSPA6
augcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccggguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccgccuauuucaaugacucgcagcgccaggccaccaaggacgcgggggccaucgcggggcucaacguguugcggaucaucaaugagcccacggcagcugccaucgccuaugggcuggaccggcggggcgcgggagagcgcaacgugcucauuuuugaccugggugggggcaccuucgaugugucgguucucuccauugacgcuggugucuuugaggugaaagccacugcuggagauacccaccugggaggagaggacuucgacaaccggcucgugaaccacuucauggaagaguuccggcggaagcaugggaaggaccugagcgggaacaagcgugcccugcgcaggcugcgcacagccugugagcgcgccaagcgcacccuguccuccagcacccaggccacccuggagauagacucccuguucgagggcguggacuucuacacguccaucacucgugcccgcuuugaggaacugugcucagaccucuuccgcagcacccuggagccgguggagaaggcccugcgggaugccaagcuggacaaggcccagauucaugacgucguccugguggggggcuccacacgcauccccaaggugcagaaguugcugcaggacuucuucaacggcaaggagcugaacaagagcaucaacccugaugaggcuguggccuauggggcugcugugcaggcggccguguugaugggggacaaaugugagaaagugcaggaucuccugcugcuggauguggcuccccugucucuggggcuggagacagcaggaggggugaugaccacgcugauccagaggaacgccacuauccccaccaagcagacccagacuuucaccaccuacucggacaaccagccuggggucuucauccagguguaugagggugagagggccaugaccaaggacaacaaccugcuggggcguuuugaacucaguggcaucccuccugccccacguggagucccccagauagaggugacuuuugacauugaugcuaauggcauccugagcgugacagccacugacaggagcacagguaaggcuaacaagaucaccaucaccaaugacaagggccggcugagcaaggaggagguggagaggaugguucaugaagccgagcaguacaaggcugaggaugaggcccagagggacagaguggcugccaaaaacucgcuggaggcccaugucuuccaugugaaagguucuuugcaagaggaaagccuuagggacaagauucccgaagaggacaggcgcaaaaugcaagacaagugucgggaaguccuugccuggcuggagcacaaccagcuggcagagaaggaggaguaugagcaucagaagagggagcuggagcaaaucugucgccccaucuucuccaggcucuauggggggccuggugucccugggggcagcaguuguggcacucaagcccgccagggggaccccagcaccggccccaucauugaggagguugauuga

SEQ ID NO: 5983 - RNA, 1104 nt, Artificial Sequence
  derived and/or modified CDS sequence (wt) from Homo sapiens__P48741__HsHSPA7
augcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccagguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccaccuauuucaguaacucgcagcgccaggccaccaaggacgcgggggccaucgcggggcucaaggugcugccgaucaucaaugaggccacggcagcagccaucgccuaugggcuggaccggcggggcgcgggaaagcgcaacgugcucauuuuugaccugggugggggcaccuucgaugugucgguucucuccauugacgccggugucuuugaggugaaagccacugcuggagauacccaccugggaggagaggacuucgacaaccggcucgugaaccacuucauggaagaguuccggcggaagcaugggaaggaccugagcgggaacaagcgugcccugcgcaggcugcgcacagccugugagcgcgccaagcgcaccccguccuccagcacccaggccacccuggagauagacucccuguucgagggcguggacuucuacaaguccaucacucgugcccgcuuugaggaacugugcucagaccucuuccgcagcacccuggagccgguggagaaggcccugcgggaugccaagcuggacaaggcccagauucaugacuucguccuggggggagggcuccacucgcauccccaaggugcagaaguugcugcaggacuucuucaacggcaaggagcugaacaagagcaucaacccuga

SEQ ID NO: 5984 - RNA, 1941 nt, Artificial Sequence
  derived and/or modified CDS sequence (wt) from Homo sapiens__NP_006588.1 __HsHSPA8
auguccaagggaccugcaguugguauugaucuuggcaccaccuacucuuguguggguguuuuccagcacggaaaagucgagauaauugccaaugaucagggaaaccgaaccacuccaagcuaugucgccuuuacggacacugaacgguugaucggugaugccgcaaagaaucaaguugcaaugaaccccaccaacacaguuuuugaugccaaacgucugauuggacgcagauuugaugaugcuguuguccagucugauaugaaacauuggcccuuuaugguggugaaugaugcuggcaggcccaagguccaaguagaauacaagggagagaccaagagcuucuauccagaggaggugucuucuaugguucugacaaagaugaaggaaauugcagaagccuaccuugggaagacuguuaccaaugcuguggucacagugccagcuuacuuuaaugacucucagcgucaggcuaccaaagaugcuggaacuauugcuggucucaauguacuuagaauuauuaaugagccaacugcugcugcuauugcuuacggcuuagacaaaaagguuggagcagaaagaaacgugcucaucuuugaccugggagguggcacuuuugaugugucaauccucacuauugaggauggaaucuuugaggucaagucuacagcuggagacacccacuuggguggagaagauuuugacaaccgaauggucaaccauuuuauugcugaguuuaagcgcaagcauaagaaggacaucagugagaacaagagagcuguaagacgccuccguacugcuugugaacgugcuaagcguacccucucuuccagcacccaggccaguauugagaucgauucucucuaugaaggaaucgacuucuauaccuccauuacccgugcccgauuugaagaacugaaugcugaccuguuccguggcacccuggacccaguagagaaagcccuucgagaugccaaacuagacaagucacagauucaugauauuguccugguuggugguucuacucguauccccaagauucagaagcugcuccaagacuucuucaauggaaaagaacugaauaagagcaucaacccugaugaagcuguugcuuauggugcagcuguccaggcagccaucuugucuggagacaagucugagaauguucaagauuugcugcucuuggaugucacuccucuuucccuugguauugaaacugcugguggagucaugacuguccucaucaagcguaauaccaccauuccuaccaagcagacacagaccuucacuaccuauucugacaaccagccuggugugcuuauucagguuuaugaaggcgagcgugccaugacaaaggauaacaaccugcuuggcaaguuugaacucacaggcauaccuccugcaccccgagguguuccucagauugaagucacuuuugacauugaugccaaugguauacucaaugucucugcuguggacaagaguacgggaaaagagaacaagauuacuaucacuaaugacaagggccguuugagcaaggaagacauugaacguaugguccaggaagcugagaaguacaaagcugaagaugagaagcagagggacaaggugucauccaagaacucacuugaguccuaugccuucaacaugaaagcaacuguugaagaugagaaacuucaaggcaagauuaacgaugaggacaaacagaagauucuggacaaguguaaugaaauuaucaacuggcuugauaagaaucagacugcugagaaggaagaauuugaacaucaacagaaagagcuggagaaaguuugcaaccccaucaucaccaagcuguaccagagugcaggaggcaugccaggaggaaugccugggggauuuccuggugguggagcuccucccucugguggugcuuccucagggcccaccauugaagagguugauuaa

SEQ ID NO: 5985 - RNA, 2040 nt, Artificial Sequence
  derived and/or modified CDS sequence (wt) from Homo sapiens__NP_004125.3 __HsHSPA9
augauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaaaagccagguauucucuacugccgcugauggucaaacgcaaguggaaauuaaagugugucagggugaaagagagauggcuggagacaacaaacuccuuggacaguuuacuuugauuggaaucccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaguucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucacugaagcuguucgaaauggcauacaaaaagauggcaucugagcgagaaggcucuggaaguucuggcacuggggaacaaaaggaagaucaaaaggaggaaaaacaguaa

SEQ ID NO: 5986 - RNA, 2061 nt, Artificial Sequence
  derived and/or modified CDS sequence (wt) from Homo sapiens__NP_443202.3 __HsHSPA12B
auguuggcugucccggagaugggccugcaggggcuguacaucggcuccagcccggagcgguccccagugccuagcccacccggcuccccgaggacccaggaaagcugcggcauugccccccucacacccucgcagucuccaaaacccgagguccgagccccccagcaggccuccuucucuguggugguggccauugacuucggcaccacgucuaguggcuaugcuuucagcuuugccagugacccugaggccauccacaugaugaggaaaugggagggcggagacccgggcguggcccaccagaagaccccgaccugccugcugcugacuccggagggcgccuuccacagcuuuggcuacaccgcccgcgauuacuaccaugaccuggaccccgaagaggcgcgggacuggcucuacuucgagaaguucaagaugaagauccacagcgccacggaucucaccuugaagacccagcuagaggcaguaaauggaaagacgaugcccgcccuggagguguucgcccaugcccugcgcuucuucagggagcacgcccuucaggagcugagggagcagagcccaucgcugccagagaaggacacugugcgcuggguguugacggugccugccaucuggaaacagccagccaagcaguucaugcgggaggcugccuaccuggcuggacuugugucccgagagaaugcagagcagcuacucaucgcccuggagcccgaggccgccucgguauacugccgcaagcugcgccugcaccagcuccuggaccugaguggccgggccccagguggugggcgccugggugagcgccgcuccaucgacuccagcuuccgucaggcucgggagcagcugcgaaggucccgccacagccgcacguuccugguggagucaggcguaggagagcugugggcagagaugcaagcaggagaccgcuacgugguggccgacugcggcggaggcaccguggaccugacggugcaccagcuggagcagccccauggcacccucaaggagcucuacaaggcaucugggggcccuuauggcgcggugggcguggaccuggccuucgagcagcugcugugccgcaucuucggcgaggacuucaucgccaccuucaaaaggcaacggccggcagccuggguagaucugaccaucgccuucgaggcucgcaagcgcacugcuggcccacaccgugcaggggcgcucaacaucucgcugcccuucuccuucauugacuucuaccgcaagcagcggggccacaacguggagaccgcucugcgcaggagcagcgugaacuucgugaagugguccucacaggggaugcuccgaaugucuugugaagccaugaacgagcucuuucagcccaccgucagcgggaucauccagcacauagaggcccugcuggcacggccggaggugcagggugugaagcugcuguuccuagugggcggcuucgccgagucagcggugcugcagcacgcggugcaggcggcgcugggcgcccgcggucugcgugucguggucccgcacgacgugggccucaccauccucaaaggcgcggugcuguucggccaggcgccgggcguggugcggguccgccgcucgccgcucaccuauggcgugggcgugcucaaccgcuuugugccugggcgccacccgcccgaaaagcugcugguucgcgacggccgccgcuggugcaccgacgucuucgagcgcuucguggccgccgagcagucgguggcccugggcgaggaggugcggcgcagcuacugcccggcgcgucccggccagcggcgcguacucaucaaccuguacugcugcgcggcagaggaugcgcgcuucaucaccgaccccggcgugcgcaaaugcggcgcgcucagccucgagcuugagcccgccgacugcggccaggacaccgccggcgcgccucccggccgccgcgagauccgcgccgccaugcaguuuggcgacaccgaaauuaaggucaccgccgucgacgucagcaccaaucgcuccgugcgcgcguccaucgacuuucuuuccaacuga

SEQ ID NO: 5987 - RNA, 1530 nt, Artificial Sequence
  derived and/or modified CDS sequence (wt) from Homo sapiens__NP_057383.2__HsHSPA14
auggcggccaucggaguucaccugggcugcaccucagccuguguggccgucuauaaggauggccgggcuggugugguugcaaaugaugccggugaccgaguuacuccagcuguuguugcuuacucagaaaaugaagagauuguuggauuggcagcaaaacaaaguagaauaagaaauauuucaaauacaguaaugaaaguaaagcagauccugggcagaagcuccagugauccacaagcucagaaauacaucgcggaaaguaaauguuuagucauugaaaaaaaugggaaauuacgauaugaaauagauacuggagaagaaacaaaauuuguuaacccagaagauguugccagacugauauuuaguaaaaugaaagaaacggcacauucuguauugggcucagaugcaaaugauguaguuauuacugucccguuugauuuuggagaaaagcaaaaaaaugcucuuggagaagcagcuagagcugcuggauuuaauguuuugcgauuaauucacgaaccgucugcagcucugcuugcuuauggaauuggacaagacuccccuacuggaaaaagcaauauuuugguguuuaagcugggaggaacauccuuaucucucagcgucauggaaguuaacaguggaauauaucggguucuuucaacaaacacugaugauaacaucgguggugcacauuucacagaaaccuuagcacaguaucuagcuucugaguuccaaagauccuucaaacaugaugugagaggaaaugcgcgagccaugaugaaauuaacgaacagugcugaaguagcgaaacauucuuugucaaccuugggaagugccaacuguuuucuugacucauuauaugaaggucaagauuuugauugcaauguguccagagcaagauuugaacuucuuuguucuccacuuuuuaauaaguguauagaagcaaucagaggacucuuagaucaaaauggauuuacagcagaugauaucaacaagguuguccuuuguggagggucuucucgaaucccaaagcuacagcaacugauuaaagaucuuuucccagcuguugagcuucucaauucuaucccuccugaugaagugaucccuauuggugcagcuauagaagcaggaauccuuauugggaaagaaaaccuguugguggaagacucucuuaugauagaguguucagccagagauauuuuaguuaaggguguggacgaaucaggagccaguagauucacagugcuguuuccaucagggacuccuuugccagcucgaagacaacacacauugcaagccccuggaagcauaucuucagugugccuugaacucuaugagucugaugggaagaacucugccaaagaggaaaccaaguuugcacagguuguacuccaggauuuagauaaaaaagaaaauggauuacgugauauauuagcuguucuuacuaugaaaagggauggaucuuuacaugugacaugcacagaucaagaaacuggaaaaugugaagcaaucucuauugagauagcaucuuag

SEQ ID NO: 5988 - RNA, 2577 nt, Artificial Sequence
  derived and/or modified CDS sequence (wt) from Homo sapiens__NP_006635.2 __HsHSPH1
augucgguggugggguuggacgugggcucgcagagcugcuacaucgcgguagcccgggccgggggcaucgagaccaucgccaaugaguucagcgaccggugcaccccgucagucauaucauuuggaucaaaaaauagaacaaucggaguugcagccaaaaaucagcaaaucacucaugcaaacaauacggugucuaacuucaaaagauuucauggccgagcauucaaugaccccuucauucaaaaggagaaggaaaacuugaguuacgauuugguuccauugaaaaaugguggaguuggaauaaagguaauguacaugggugaagaacaucuauuuaguguggagcagauaacagccauguuguugacuaagcugaaggaaacugcugaaaacagccucaagaaaccaguaacagauuguguuauuucaguccccuccuucuuuacagaugcugagaggcgaucuguguuagaugcugcacagauuguuggccuaaacuguuuaagacuuaugaaugacaugacagcuguugcuuugaauuacggaauuuauaagcaggaucucccaagccuggaugagaaaccucggauagugguuuuuguugauaugggacauucagcuuuucaagugucugcuugugcuuuuaacaagggaaaauugaagguacugggaacagcuuuugauccuuucuuaggaggaaaaaacuucgaugaaaaguuaguggaacauuuuugugcagaauuuaaaacuaaguacaaguuggaugcaaaauccaaaauacgagcacuccuacgucuguaucaggaaugugaaaaacugaaaaagcuaaugagcucuaacagcacagaccuuccacugaauaucgaaugcuuuaugaaugauaaagauguuuccggaaagaugaacaggucacaauuugaagaacucugugcugaacuucugcaaaagauagaaguaccccuuuauucacuguuggaacaaacucaucucaaaguagaagaugugagugcaguugagauuguuggaggcgcuacacgaaucccagcugugaaggaaagaauugccaaauucuuuggaaaagauauuagcacaacacucaaugcagaugaagcaguagccagaggaugugcauuacagugugcaauacuuuccccggcauuuaaaguuagagaauuuuccgucacagaugcaguuccuuuuccaauaucucugaucuggaaccaugauucagaagauacugaagguguucaugaagucuuuagucgaaaccaugcugcuccuuucuccaaaguucucaccuuucugagaagggggccuuuugagcuagaagcauucuauucugauccccaaggaguuccauauccagaagcaaaaauaggccgcuuuguaguucagaauguuucugcacagaaagauggagaaaaaucuagaguaaaagucaaagugcgagucaacacccauggcauuuucaccaucucuacggcaucuaugguggagaaagucccaacugaggagaaugaaaugucuucugaagcugacauggagugucugaaucagagaccaccagaaaacccagacacugauaaaaauguccagcaagacaacagugaagcuggaacacagccccagguacaaacugaugcucaacaaaccucacagucucccccuucaccugaacuuaccucagaagaaaacaaaaucccagaugcugacaaagcaaaugaaaaaaaaguugaccagccuccagaagcuaaaaagcccaaaauaaagguggugaauguugagcugccuauugaagccaacuuggucuggcaguuagggaaagaccuucuuaacauguauauugagacagaggguaagaugauaaugcaagauaaauuggaaaaagaaaggaaugaugcuaaaaaugcaguugaggaauauguguaugaguucagagacaagcuguguggaccauaugaaaaauuuauaugugagcaggaucaucaaaauuuuuugagacuccucacagaaacugaagacuggcuguaugaagaaggagaggaccaagcuaaacaagcauauguugacaaguuggaagaauuaaugaaaauuggcacuccaguuaaaguucgguuucaggaagcugaagaacggccaaaaauguuugaagaacuaggacagaggcugcagcauuaugccaagauagcagcugacuucagaaauaaggaugagaaauacaaccauauugaugagucugaaaugaaaaaaguggagaagucuguuaaugaagugauggaauggaugaauaaugucaugaaugcucaggcuaaaaagagucuugaucaggauccaguuguacgugcucaggaaauuaaaacaaaaaucaaggaauugaacaacacaugugaacccguuguaacacaaccgaaaccaaaaauugaaucacccaaacuggaaagaacuccaaauggcccaaauauugauaaaaaggaagaagauuuagaagacaaaaacaauuuuggugcugaaccuccacaucagaauggugaauguuacccuaaugagaaaaauucuguuaauauggacuuggacuag

SEQ ID NO: 5989 - RNA, 3000 nt, Artificial Sequence
  derived and/or modified CDS sequence (wt) from Homo sapiens__NP_006380.1 __HsHYOU1
auggcagacaaaguuaggaggcagaggccgaggaggcgagucuguugggccuugguggcugugcucuuggcagaccuguuggcacugagugauacacuggcagugaugucuguggaccugggcagugaguccaugaagguggccauugucaaaccuggagugcccauggaaauugucuugaauaaggaaucucggaggaaaacaccggugaucgugacccugaaagaaaaugaaagauucuuuggagacagugcagcaagcauggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgcagcugcaguucucaccugaggaaguguugggcaugguucucaauuauucucguucucuagcugaagauuuugcagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccagaauaucauguucuaugacaugggcucaggcagcaccguaugcaccauugugaccuaccagauggugaagacuaaggaagcugggaugcagccacagcugcagauccggggaguaggauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacagauugaaggccugauggaugauguggacuucaaggcaaaagugacucguguggaauuugaggaguugugugcagacuuguuugagcgggugccugggccuguacagcaggcccuccagagugccgaaaugagucuggaugagauugagcaggucauccugguggguggggccacucggguccccagaguucaggaggugcugcugaaggccgugggcaaggaggagcuggggaagaacaucaaugcagaugaagcagccgccaugggggcaguguaccaggcagcugcgcucagcaaagccuuuaaagugaagccauuugucguccgagaugcaguggucuaccccauccugguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggguauuuggcucccagaaucugaccacagugaagcuaaaaggggugggugacagcuucaagaaguauccugacuacgaguccaagggcaucaaggcucacuucaaccuggaugagaguggcgugcucagucuagacaggguggagucuguauuugagacacugguagaggacagcgcagaagaggaaucuacucucaccaaacuuggcaacaccauuuccagccuguuuggaggcgguaccacaccagaugccaaggagaaugguacugauacuguccaggaggaagaggagagcccugcagaggggagcaaggacgagccuggggagcaggucgagcucaaggaggaagcugaggccccaguggaggauggcucucagcccccacccccugaaccuaagggagaugcaaccccugagggagaaaaggccacagaaaaagaaaauggggacaagucugaggcccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaacuucaggacuugacacuccgagaccuggagaagcaggaacgggaaaaagcugccaacagcuuggaagcauucauauuugagacccaggacaagcuguaccagcccgaguaccaggaaguguccacagaggagcagcgugaggagaucucugggaagcucagcgccgcauccaccuggcuggaggaugaggguguuggagccaccacagugauguugaaggagaagcuggcugagcugaggaagcugugccaagggcuguuuuuucggguagaggagcgcaagaaguggcccgaacggcugucugcccucgauaaucuccucaaccauuccagcauguuccucaagggggcccggcucaucccagagauggaccagaucuucacugagguggagaugacaacguuagagaaagucaucaaugagaccugggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggccagacugaagaugcagagcccauuucagaaccugagaaaguagagacuggauccgagccaggagacacugagccuuuggaguuaggagguccuggagcagaaccugaacagaaagaacaaucgacaggacagaagcggccuuugaagaacgacgaacuauaa

SEQ ID NO: 5990 - RNA, 2199 nt, Artificial Sequence
  derived and/or modified CDS sequence (wt) from Homo sapiens__NP_005339.3 __HsHSP90AA1
augccugaggaaacccagacccaagaccaaccgauggaggaggaggagguugagacguucgccuuucaggcagaaauugcccaguugaugucauugaucaucaauacuuucuacucgaacaaagagaucuuucugagagagcucauuucaaauucaucagaugcauuggacaaaauccgguaugagagcuugacagaucccaguaaauuagacucugggaaagagcugcauauuaaccuuauaccgaacaaacaagaucgaacucucacuauuguggauacuggaauuggaaugaccaaggcugacuugaucaauaaccuugguacuaucgccaagucugggaccaaagcguucauggaagcauugcaggcuggugcagauaucucuaugauuggccaguucgguguugguuuuuauucugcuuauuugguugcugagaaaguaacugugaucaccaaacauaacgaugaugagcaguacgcuugggaguccucagcagggggaucauucacagugaggacagacacaggugaaccuaugggucguggaacaaaaguuauccuacaccugaaagaagaccaaacugaguacuuggaggaacgaagaauaaaggagauugugaagaaacauucucaguuuauuggauaucccauuacucuuuuuguggagaaggaacgugauaaagaaguaagcgaugaugaggcugaagaaaaggaagacaaagaagaagaaaaagaaaaagaagagaaagagucggaagacaaaccugaaauugaagauguugguucugaugaggaagaagaaaagaaggauggugacaagaagaagaagaagaagauuaaggaaaaguacaucgaucaagaagaacucaacaaaacaaagcccaucuggaccagaaaucccgacgauauuacuaaugaggaguacggagaguucuauaagagcuugaccaaugacugggaagaucacuuggcagugaagcauuuuucaguugaaggacaguuggaguucagagcccuucuauuugucccacgacgugcuccuuuugaucuguuugaaaacagaaagaaaaagaacaacaucaaauuguauguacgcagaguuuucaucauggauaacugugaggagcuaaucccugaauaucugaacuucauuagaggggugguagacucggaggaucucccucuaaacauaucccgugagauguugcaacaaagcaaaauuuugaaaguuaucaggaagaauuuggucaaaaaaugcuuagaacucuuuacugaacuggcggaagauaaagagaacuacaagaaauucuaugagcaguucucuaaaaacauaaagcucggaauacacgaagacucucaaaaucggaagaagcucucagagcuguuaagguacuacacaucugccucuggugaugagaugguuucucucaaggacuacugcaccagaaugaaggagaaccagaaacauaucuauuauaucacaggugagaccaaggaccagguagcuaacucagccuuuguggaacgucuucggaaacauggcuuagaagugaucuauaugauugagcccauugaugaguacuguguccaacagcugaaggaauuugaggggaagacuuuagugucagucaccaaagaaggccuggaacuuccagaggaugaagaagagaaaaagaagcaggaagagaaaaaaacaaaguuugagaaccucugcaaaaucaugaaagacauauuggagaaaaaaguugaaaaggugguugugucaaaccgauuggugacaucuccaugcuguauugucacaagcacauauggcuggacagcaaacauggagagaaucaugaaagcucaagcccuaagagacaacucaacaauggguuacauggcagcaaagaaacaccuggagauaaacccugaccauuccauuauugagaccuuaaggcaaaaggcagaggcugauaagaacgacaagucugugaaggaucuggucaucuugcuuuaugaaacugcgcuccugucuucuggcuucagucuggaagauccccagacacaugcuaacaggaucuacaggaugaucaaacuuggucuggguauugaugaagaugacccuacugcugaugauaccagugcugcuguaacugaagaaaugccaccccuugaaggagaugacgacacaucacgcauggaagaaguagacuaa

SEQ ID NO: 5991 - RNA, 339 nt, Artificial Sequence
  derived and/or modified CDS sequence (wt) from Homo sapiens__NG_005218__HsHSP90AA3P
auggauuccaguaaauuagacucugggaaagggcugcauauuaaccuuguaccaaacaaacaaaaucaaacccucacuauuguggacacuagaauuggaaugaccaagacugacuugaucaauaaccucgguacugucaccaagucugggaccaaagcauucauggaagcauugcaggcugaugcagauaucucuaugauuggccauuucgggguugguuuuuauucugcuuauuugguugccaagaaaguaacugugaucagcaaacauaacaaugaugagcaguacaccugggaguccucagcagggggaucauucacagugaggacagacgaguga

SEQ ID NO: 5992 - RNA, 2175 nt, Artificial Sequence
  derived and/or modified CDS sequence (wt) from Homo sapiens__NP_031381.2__HsHSP90AB1
augccugaggaagugcaccauggagaggaggagguggagacuuuugccuuucaggcagaaauugcccaacucaugucccucaucaucaauaccuucuauuccaacaaggagauuuuccuucgggaguugaucucuaaugcuucugaugccuuggacaagauucgcuaugagagccugacagacccuucgaaguuggacagugguaaagagcugaaaauugacaucauccccaacccucaggaacguacccugacuuugguagacacaggcauuggcaugaccaaagcugaucucauaaauaauuugggaaccauugccaagucugguacuaaagcauucauggaggcucugcaggcuggugcagacaucuccaugauugggcaguuugguguuggcuuuuauucugccuacuugguggcagagaaagugguugugaucacaaagcacaacgaugaugaacaguaugcuugggagucuucugcuggagguuccuucacugugcgugcugaccauggugagcccauuggcagggguaccaaagugauccuccaucuuaaagaagaucagacagaguaccuagaagagaggcgggucaaagaaguagugaagaagcauucucaguucauaggcuaucccaucacccuuuauuuggagaaggaacgagagaaggaaauuagugaugaugaggcagaggaagagaaaggugagaaagaagaggaagauaaagaugaugaagaaaaacccaagaucgaagauguggguucagaugaggaggaugacagcgguaaggauaagaagaagaaaacuaagaagaucaaagagaaauacauugaucaggaagaacuaaacaagaccaagccuauuuggaccagaaacccugaugacaucacccaagaggaguauggagaguucuacaagagccucacuaaugacugggaagaccacuuggcagucaagcacuuuucuguagaaggucaguuggaguucagggcauugcuauuuauuccucgucgggcucccuuugaccuuuuugagaacaagaagaaaaagaacaacaucaaacucuauguccgccguguguucaucauggacagcugugaugaguugauaccagaguaucucaauuuuauccguggugugguugacucugaggaucugccccugaacaucucccgagaaaugcuccagcagagcaaaaucuugaaagucauucgcaaaaacauuguuaagaagugccuugagcuguucucugagcuggcagaagacaaggagaauuacaagaaauucuaugaggcauucucuaaaaaucucaagcucggaauccacgaagacuccacuaaccgccgccgccugucugagcugcugcgcuaucauaccucccagucuggagaugagaugacaucucugucagaguauguuucucgcaugaaggagacacagaaguccaucuauuacaucacuggugagagcaaagagcaggucgccaacucagcuuuuguggagcgagugcggaaacggggcuucgaggugguauauaugaccgagcccauugacgaguacugugugcagcagcucaaggaauuugaugggaaaagccuggucucaguuaccaaggagggucuggagcugccugaggaugaggaggagaagaagaagauggaagagagcaaggcaaaguuugagaaccucugcaagcucaugaaagaaaucuuagauaagaagguugagaaggugacaaucuccaauagacuugugucuucaccuugcugcauugugaccagcaccuacggcuggacagccaauauggagcggaucaugaaagcccaggcacuucgggacaacuccaccaugggcuauaugauggccaaaaagcaccuggagaucaacccugaccaccccauuguggagacgcugcggcagaaggcugaggccgacaagaaugauaaggcaguuaaggaccugguggugcugcuguuugaaaccgcccugcuaucuucuggcuuuucccuugaggauccccagacccacuccaaccgcaucuaucgcaugaucaagcuaggucuagguauugaugaagaugaaguggcagcagaggaacccaaugcugcaguuccugaugagauccccccucucgagggcgaugaggaugcgucucgcauggaagaagucgauuag

SEQ ID NO: 5993 - RNA, 2412 nt, Artificial Sequence
  derived and/or modified CDS sequence (wt) from Homo sapiens__NP_003290.1__HsHSP90B1
augagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcauucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcugguucguaaaacgcuggacaugaucaagaagauugcugaugauaaauacaaugauacuuuuuggaaagaauuugguaccaacaucaagcugggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagaacccgaagaagaaccugaagagacagcagaagacacaacagaagacacagagcaagacgaagaugaagaaauggaugugggaacagaugaagaagaagaaacagcaaaggaaucuacagcugaaaaagaugaauuguaa

SEQ ID NO: 5994 - RNA, 2115 nt, Artificial Sequence
  derived and/or modified CDS sequence (wt) from Homo sapiens__NP_057376.2__HsTRAP1
auggcgcgcgagcugcgggcgcugcugcuguggggccgccgccugcggccuuugcugcgggcgccggcgcuggcggccgugccgggaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguuccacuuccaaacaugaguuccaggccgagacaaagaagcuguuggacauuguugcccggucccuguacucagaaaaagagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccaggauacugguaucgggaugacacaggaagaacugguguccaaccuggggacgauugccagaucggggucaaaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugguucuggaguguuugaaaucgccgaagcaucgggaguuagaaccgggacaaaaaucaucauccaccugaaauccgacugcaaggaguuuuccagcgaggcccgggugcgagaugugguaacgaaguacagcaacuucgucagcuuccccuuguacuugaauggaaggcggaugaacaccuugcaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacaugaaaccguccauguuugaugugagccgggagcugggcuccagcguugcacuguacagccgcaaaguccucauccagaccaaggccacggacauccugcccaaguggcugcgcuucauccgaggugugguggacagugaggacauuccccugaaccucagccgggagcugcugcaggagagcgcacucaucaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagagguucucuucugcuuugagcaguuugaugagcucacccugcugcaccuucgugaguuugacaagaagaagcugaucucuguggagacggacauagucguggaucacuacaaggaggagaaguuugaggacagguccccagccgccgagugccuaucagagaaggagacggaggagcucauggccuggaugagaaaugugcuggggucgcgugucaccaacgugaaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggcacgcgcucaucaagaagcugaaucagcugcgcgcaagcgagccuggccuggcucagcugcugguggaucagauauacgagaacgccaugauugcugcuggacuuguugacgacccuagggccauggugggccgcuugaaugagcugcuugucaaggcccuggagcgacacuga

SEQ ID NO: 5995 - RNA, 462 nt, Artificial Sequence
  derived and/or modified CDS sequence (wt) from Homo sapiens__NP_000609.1__HsIGF1
augggaaaaaucagcagucuuccaacccaauuauuuaagugcugcuuuugugauuucuugaaggugaagaugcacaccauguccuccucgcaucucuucuaccuggcgcugugccugcucaccuucaccagcucugccacggcuggaccggagacgcucugcggggcugagcugguggaugcucugcaguucguguguggagacaggggcuuuuauuucaacaagcccacaggguauggcuccagcagucggagggcgccucagacaggcaucguggaugagugcugcuuccggagcugugaucuaaggaggcuggagauguauugcgcaccccucaagccugccaagucagcucgcucuguccgugcccagcgccacaccgacaugcccaagacccagaaggaaguacauuugaagaacgcaaguagagggagugcaggaaacaagaacuacaggauguag

SEQ ID NO: 5996 - RNA, 639 nt, Artificial Sequence
  derived and/or modified CDS sequence (wt) from Homo sapiens__NP_000591.1__HsIL6
augaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcugugcagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucugcggcaaauguag

SEQ ID NO: 5997 - RNA, 1281 nt, Artificial Sequence
  derived and/or modified CDS sequence (wt) from Homo sapiens__NP_002183.1__HsINHBA
augcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcugcaugugggcaaagucggggagaacggguauguggagauagaggaugacauuggaaggagggcagaaaugaaugaacuuauggagcagaccucggagaucaucacguuugccgagucaggaacagccaggaagacgcugcacuucgagauuuccaaggaaggcagugaccugucagugguggagcgugcagaagucuggcuguuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaaaagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauag

SEQ ID NO: 5998 - RNA, 3459 nt, Artificial Sequence
  derived and/or modified CDS sequence (wt) from Homo sapiens__NP_000623.2__HsITGAM
auggcucucagaguccuucuguuaacagccuugaccuuaugucauggguucaacuuggacacugaaaacgcaaugaccuuccaagagaacgcaaggggcuucgggcagagcgugguccagcuucagggauccaggguggugguuggagccccccaggagauaguggcugccaaccaaaggggcagccucuaccagugcgacuacagcacaggcucaugcgagcccauccgccugcagguccccguggaggccgugaacaugucccugggccugucccuggcagccaccaccagccccccucagcugcuggccuguggucccaccgugcaccagacuugcagugagaacacguaugugaaagggcucugcuuccuguuuggauccaaccuacggcagcagccccagaaguucccagaggcccuccgaggguguccucaagaggauagugacauugccuucuugauugauggcucugguagcaucaucccacaugacuuucggcggaugaaggaguuugucucaacugugauggagcaauuaaaaaaguccaaaaccuuguucucuuugaugcaguacucugaagaguuccggauucacuuuaccuucaaagaguuccagaacaacccuaacccaagaucacuggugaagccaauaacgcagcugcuugggcggacacacacggccacgggcauccgcaaagugguacgagagcuguuuaacaucaccaacggagcccgaaagaaugccuuuaagauccuaguugucaucacggauggagaaaaguuuggcgaucccuugggauaugaggaugucaucccugaggcagacagagagggagucauucgcuacgucauuggggugggagaugccuuccgcagugagaaaucccgccaagagcuuaauaccaucgcauccaagccgccucgugaucacguguuccaggugaauaacuuugaggcucugaagaccauucagaaccagcuucgggagaagaucuuugcgaucgaggguacucagacaggaaguagcagcuccuuugagcaugagaugucucaggaaggcuucagcgcugccaucaccucuaauggccccuugcugagcacuguggggagcuaugacugggcugguggagucuuucuauauacaucaaaggagaaaagcaccuucaucaacaugaccagaguggauucagacaugaaugaugcuuacuuggguuaugcugccgccaucaucuuacggaaccgggugcaaagccugguucugggggcaccucgauaucagcacaucggccugguagcgauguucaggcagaacacuggcaugugggaguccaacgcuaaugucaagggcacccagaucggcgccuacuucggggccucccucugcuccguggacguggacagcaacggcagcaccgaccugguccucaucggggccccccauuacuacgagcagacccgagggggccagguguccgugugccccuugcccagggggagggcucgguggcagugugaugcuguucucuacggggagcagggccaacccuggggccgcuuuggggcagcccuaacagugcugggggacguaaauggggacaagcugacggacguggccauuggggccccaggagaggaggacaaccggggugcuguuuaccuguuucacggaaccucaggaucuggcaucagccccucccauagccagcggauagcaggcuccaagcucucucccaggcuccaguauuuuggucagucacugagugggggccaggaccucacaauggauggacugguagaccugacuguaggagcccaggggcacgugcugcugcucaggucccagccaguacugagagucaaggcaaucauggaguucaaucccagggaaguggcaaggaauguauuugaguguaaugaucagguggugaaaggcaaggaagccggagaggucagagucugccuccauguccagaaaagcacacgggaucggcuaagagaaggacagauccagaguguugugacuuaugaccuggcucuggacuccggccgcccacauucccgcgccgucuucaaugagacaaagaacagcacacgcagacagacacaggucuuggggcugacccagacuugugagacccugaaacuacaguugccgaauugcaucgaggacccagugagccccauugugcugcgccugaacuucucucuggugggaacgccauugucugcuuucgggaaccuccggccagugcuggcggaggaugcucagagacucuucacagccuuguuucccuuugagaagaauuguggcaaugacaacaucugccaggaugaccucagcaucaccuucaguuucaugagccuggacugccucguggugggugggccccgggaguucaacgugacagugacugugagaaaugauggugaggacuccuacaggacacaggucaccuucuucuucccgcuugaccuguccuaccggaagguguccacgcuccagaaccagcgcucacagcgauccuggcgccuggccugugagucugccuccuccaccgaagugucuggggccuugaaaagcaccagcugcagcauaaaccaccccaucuucccggaaaacucagaggucaccuuuaauaucacguuugauguagacucuaaggcuucccuuggaaacaaacugcuccucaaggccaaugugaccagugagaacaacaugcccagaaccaacaaaaccgaguuccaacuggagcugccggugaaauaugcugucuacaugguggucaccagccauggggucuccacuaaauaucucaacuucacggccucagagaauaccagucgggucaugcagcaucaauaucaggucagcaaccuggggcagaggagccuccccaucagccugguguucuuggugcccguccggcugaaccagacugucauaugggaccgcccccaggucaccuucuccgagaaccucucgaguacgugccacaccaaggagcgcuugcccucucacuccgacuuucuggcugagcuucggaaggcccccguggugaacugcuccaucgcugucugccagagaauccagugugacaucccguucuuuggcauccaggaagaguucaaugcuacccucaaaggcaaccucucguuugacugguacaucaagaccucgcauaaccaccuccugaucgugagcacagcugagaucuuguuuaacgauuccguguucacccugcugccgggacagggggcguuugugaggucccagacggagaccaaaguggagccguucgagguccccaacccccugccgcucaucgugggcagcucugucgggggacugcugcuccuggcccucaucaccgccgcgcuguacaagcucggcuucuucaagcggcaauacaaggacaugaugagugaagggggucccccgggggccgaaccccaguag

SEQ ID NO: 5999 - RNA, 1404 nt, Artificial Sequence
  derived and/or modified CDS sequence (wt) from Homo sapiens__NP_002415.1__HsMMP8
auguucucccugaagacgcuuccauuucugcucuuacuccaugugcagauuuccaaggccuuuccuguaucuucuaaagagaaaaauacaaaaacuguucaggacuaccuggaaaaguucuaccaauuaccaagcaaccaguaucagucuacaaggaagaauggcacuaaugugaucguugaaaagcugaaagaaaugcagcgauuuuuuggguugaaugugacggggaagccaaaugaggaaacucuggacaugaugaaaaagccucgcuguggagugccugacaguggugguuuuauguuaaccccaggaaaccccaagugggaacgcacuaacuugaccuacaggauucgaaacuauaccccacagcugucagaggcugagguagaaagagcuaucaaggaugccuuugaacucuggaguguugcaucaccucucaucuucaccaggaucucacagggagaggcagauaucaacauugcuuuuuaccaaagagaucacggugacaauucuccauuugauggacccaauggaauccuugcucaugccuuucagccaggccaagguauuggaggagaugcucauuuugaugccgaagaaacauggaccaacaccuccgcaaauuacaacuuguuucuuguugcugcucaugaauuuggccauucuuuggggcucgcucacuccucugacccuggugccuugauguaucccaacuaugcuuucagggaaaccagcaacuacucacucccucaagaugacaucgauggcauucaggccaucuauggacuuucaagcaacccuauccaaccuacuggaccaagcacacccaaacccugugaccccaguuugacauuugaugcuaucaccacacuccguggagaaauacuuuucuuuaaagacagguacuucuggagaaggcauccucagcuacaaagagucgaaaugaauuuuauuucucuauucuggccaucccuuccaacugguauacaggcugcuuaugaagauuuugacagagaccucauuuuccuauuuaaaggcaaccaauacugggcucugaguggcuaugauauucugcaagguuaucccaaggauauaucaaacuauggcuuccccagcagcguccaagcaauugacgcagcuguuuucuacagaaguaaaacauacuucuuuguaaaugaccaauucuggagauaugauaaccaaagacaauucauggagccagguuaucccaaaagcauaucaggugccuuuccaggaauagagaguaaaguugaugcaguuuuccagcaagaacauuucuuccaugucuucaguggaccaagauauuacgcauuugaucuuauugcucagagaguuaccagaguugcaagaggcaauaaauggcuuaacuguagauauggcuga

SEQ ID NO: 6000 - RNA, 2124 nt, Artificial Sequence
  derived and/or modified CDS sequence (wt) from Homo sapiens__NP_004985.2__HsMMP9
augagccucuggcagccccugguccuggugcuccuggugcugggcugcugcuuugcugcccccagacagcgccaguccacccuugugcuguucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcuguucggcuucugcccgacccgagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuguucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuag

SEQ ID NO: 6001 - RNA, 1068 nt, Artificial Sequence
  derived and/or modified CDS sequence (wt) from Homo sapiens__NP_001286.1__HsCCR1
auggaaacuccaaacaccacagaggacuaugacacgaccacagaguuugacuauggggaugcaacuccgugccagaaggugaacgagagggccuuuggggcccaacugcugcccccucuguacuccuugguauuugucauuggccugguuggaaacauccuggugguccugguccuugugcaauacaagaggcuaaaaaacaugaccagcaucuaccuccugaaccuggccauuucugaccugcuguuccuguucacgcuucccuucuggaucgacuacaaguugaaggaugacuggguuuuuggugaugccauguguaagauccucucuggguuuuauuacacaggcuuguacagcgagaucuuuuucaucauccugcugacgauugacagguaccuggccaucguccacgccguguuugccuugcgggcacggaccgucacuuuuggugucaucaccagcaucaucauuugggcccuggccaucuuggcuuccaugccaggcuuauacuuuuccaagacccaaugggaguucacucaccacaccuguagccuucacuuuccucacgaaagccuacgagaguggaagcuguuucaggcucugaaacugaaccucuuugggcugguauugccuuuguuggucaugaucaucugcuacacagggauuauaaagauucugcuaagacgaccaaaugagaagaaauccaaagcuguccguuugauuuuugucaucaugaucaucuuuuuucucuuuuggacccccuacaauuugacuauacuuauuucuguuuuccaagacuuccuguucacccaugagugugagcagagcagacauuuggaccuggcugugcaagugacggaggugaucgccuacacgcacugcugugucaacccagugaucuacgccuucguuggugagagguuccggaaguaccugcggcaguuguuccacaggcguguggcugugcaccugguuaaauggcuccccuuccucuccguggacaggcuggagagggucagcuccacaucucccuccacaggggagcaugaacucucugcuggguucuga

SEQ ID NO: 6002 - RNA, 726 nt, Artificial Sequence
  derived and/or modified CDS sequence (wt) from Homo sapiens__NP_002599.1__HsPDGFB
augaaucgcugcugggcgcuguuccugucucucugcugcuaccugcgucuggucagcgccgagggggaccccauucccgaggagcuuuaugagaugcugagugaccacucgauccgcuccuuugaugaucuccaacgccugcugcacggagaccccggagaggaagauggggccgaguuggaccugaacaugacccgcucccacucuggaggcgagcuggagagcuuggcucguggaagaaggagccuggguucccugaccauugcugagccggccaugaucgccgagugcaagacgcgcaccgagguguucgagaucucccggcgccucauagaccgcaccaacgccaacuuccugguguggccgcccuguguggaggugcagcgcugcuccggcugcugcaacaaccgcaacgugcagugccgccccacccaggugcagcugcgaccuguccaggugagaaagaucgagauugugcggaagaagccaaucuuuaagaaggccacggugacgcuggaagaccaccuggcaugcaagugugagacaguggcagcugcacggccugugacccgaagcccgggggguucccaggagcagcgagccaaaacgccccaaacucgggugaccauucggacggugcgaguccgccggccccccaagggcaagcaccggaaauucaagcacacgcaugacaagacggcacugaaggagacccuuggagccuag

SEQ ID NO: 6003 - RNA, 1095 nt, Artificial Sequence
  derived and/or modified CDS sequence (wt) from Homo sapiens__NP_149126.1__HsPDGFD
augcaccggcucaucuuugucuacacucuaaucugcgcaaacuuuugcagcugucgggacacuucugcaaccccgcagagcgcauccaucaaagcauugcgcaacgccaaccucaggcgagaugacuuguaccgaagagaugagaccauccaggugaaaggaaacggcuacgugcagaguccuagauucccgaacagcuaccccaggaaccugcuccugacauggcggcuucacucucaggagaauacacggauacagcuaguguuugacaaucaguuuggauuagaggaagcagaaaaugauaucuguagguaugauuuuguggaaguugaagauauauccgaaaccaguaccauuauuagaggacgaugguguggacacaaggaaguuccuccaaggauaaaaucaagaacgaaccaaauuaaaaucacauucaaguccgaugacuacuuuguggcuaaaccuggauucaagauuuauuauucuuugcuggaagauuuccaacccgcagcagcuucagagaccaacugggaaucugucacaagcucuauuucagggguauccuauaacucuccaucaguaacggaucccacucugauugcggaugcucuggacaaaaaaauugcagaauuugauacaguggaagaucugcucaaguacuucaauccagagucauggcaagaagaucuugagaauauguaucuggacaccccucgguaucgaggcaggucauaccaugaccggaagucaaaaguugaccuggauaggcucaaugaugaugccaagcguuacaguugcacucccaggaauuacucggucaauauaagagaagaacugaaguuggccaauguggucuucuuuccacguugccuccucgugcagcgcuguggaggaaauuguggcuguggaacugucaacuggagguccugcacaugcaauucagggaaaaccgugaaaaaguaucaugagguauuacaguuugagccuggccacaucaagaggagggguagagcuaagaccauggcucuaguugacauccaguuggaucaccaugaacgaugugauuguaucugcagcucaagaccaccucgauaa

SEQ ID NO: 6004 - RNA, 678 nt, Artificial Sequence
  derived and/or modified CDS sequence (wt) from Homo sapiens__NP_003946.3__HsSOCS3
auggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagggccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaa

SEQ ID NO: 6005 - RNA, 1173 nt, Artificial Sequence
  derived and/or modified CDS sequence (wt) from Homo sapiens__NP_000651.3__HsTGFB1
augccgcccuccgggcugcggcugcugccgcugcugcuaccgcugcuguggcuacuggugcugacgccuggccggccggccgcgggacuauccaccuguaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacgaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccagaaauacagcaacaauuccuggcgauaccucagcaaccggcugcuggcacccagcgacucgccagagugguuaucuuuugaugucaccggaguugugcggcagugguugagccguggaggggaaauugagggcuuucgccuuagcgcccacugcuccugugacagcagggauaacacacugcaaguggacaucaacggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcuga

SEQ ID NO: 6006 - RNA, 1245 nt, Artificial Sequence
  derived and/or modified CDS sequence (wt) from Homo sapiens__NP_003229.1__HsTGFB2
augcacuacugugugcugagcgcuuuucugauccugcaucuggucacggucgcgcucagccugucuaccugcagcacacucgauauggaccaguucaugcgcaagaggaucgaggcgauccgcgggcagauccugagcaagcugaagcucaccagucccccagaagacuauccugagcccgaggaaguccccccggaggugauuuccaucuacaacagcaccagggacuugcuccaggagaaggcgagccggagggcggccgccugcgagcgcgagaggagcgacgaagaguacuacgccaaggagguuuacaaaauagacaugccgcccuucuuccccuccgaaaaugccaucccgcccacuuucuacagacccuacuucagaauuguucgauuugacgucucagcaauggagaagaaugcuuccaauuuggugaaagcagaguucagagucuuucguuugcagaacccaaaagccagagugccugaacaacggauugagcuauaucagauucucaaguccaaagauuuaacaucuccaacccagcgcuacaucgacagcaaaguugugaaaacaagagcagaaggcgaauggcucuccuucgauguaacugaugcuguucaugaauggcuucaccauaaagacaggaaccugggauuuaaaauuagcuuacacugucccugcugcacuuuuguaccaucuaauaauuacaucaucccaaauaaaagugaagaacuagaagcaagauuugcagguauugauggcaccuccacauauaccaguggugaucagaaaacuauaaaguccacuaggaaaaaaaacagugggaagaccccacaucuccugcuaauguuauugcccuccuacagacuugagucacaacagaccaaccggcggaagaagcgugcuuuggaugcggccuauugcuuuagaaaugugcaggauaauugcugccuacguccacuuuacauugauuucaagagggaucuaggguggaaauggauacacgaacccaaaggguacaaugccaacuucugugcuggagcaugcccguauuuauggaguucagacacucagcacagcaggguccugagcuuauauaauaccauaaauccagaagcaucugcuucuccuugcugcgugucccaagauuuagaaccucuaaccauucucuacuacauuggcaaaacacccaagauugaacagcuuucuaauaugauuguaaagucuugcaaaugcagcuaa

SEQ ID NO: 6007 - RNA, 1239 nt, Artificial Sequence
  derived and/or modified CDS sequence (wt) from Homo sapiens__NP_003230.1__HsTGFB3
augaagaugcacuugcaaagggcucuggugguccuggcccugcugaacuuugccacggucagccucucucuguccacuugcaccaccuuggacuucggccacaucaagaagaagaggguggaagccauuaggggacagaucuugagcaagcucaggcucaccagccccccugagccaacggugaugacccacguccccuaucagguccuggcccuuuacaacagcacccgggagcugcuggaggagaugcauggggagagggaggaaggcugcacccaggaaaacaccgagucggaauacuaugccaaagaaauccauaaauucgacaugauccaggggcuggcggagcacaacgaacuggcugucugcccuaaaggaauuaccuccaagguuuuccgcuucaauguguccucaguggagaaaaauagaaccaaccuauuccgagcagaguuccgggucuugcgggugcccaaccccagcucuaagcggaaugagcagaggaucgagcuguuccagauccuucggccagaugagcacauugccaaacagcgcuauaucgguggcaagaaucugcccacacggggcacugccgaguggcuguccuuugaugucacugacacugugcgugaguggcuguugagaagagaguccaacuuaggucuagaaaucagcauucacuguccaugucacaccuuucagcccaauggagauauccuggaaaacauucacgaggugauggaaaucaaauucaaaggcguggacaaugaggaugaccauggccguggagaucuggggcgccucaagaagcagaaggaucaccacaacccucaucuaauccucaugaugauucccccacaccggcucgacaacccgggccaggggggucagaggaagaagcgggcuuuggacaccaauuacugcuuccgcaacuuggaggagaacugcugugugcgcccccucuacauugacuuccgacaggaucugggcuggaaguggguccaugaaccuaagggcuacuaugccaacuucugcucaggcccuugcccauaccuccgcagugcagacacaacccacagcacggugcugggacuguacaacacucugaacccugaagcaucugccucgccuugcugcgugccccaggaccuggagccccugaccauccuguacuauguugggaggacccccaaaguggagcagcucuccaacaugguggugaagucuuguaaauguagcuga

SEQ ID NO: 6008 - RNA, 1386 nt, Artificial Sequence
  derived and/or modified CDS sequence (wt) from Homo sapiens__NP_001057.1__HsTNFRSF1B
auggcgcccgucgccgucugggccgcgcuggccgucggacuggagcucugggcugcggcgcacgccuugcccgcccagguggcauuuacacccuacgccccggagcccgggagcacaugccggcucagagaauacuaugaccagacagcucagaugugcugcagcaaaugcucgccgggccaacaugcaaaagucuucuguaccaagaccucggacaccgugugugacuccugugaggacagcacauacacccagcucuggaacuggguucccgagugcuugagcuguggcucccgcuguagcucugaccagguggaaacucaagccugcacucgggaacagaaccgcaucugcaccuguaggcccggcugguacugcgcgcugagcaagcaggaggggugccggcugugcgcgccgcugcgcaagugccgcccgggcuucggcguggccagaccaggaacugaaacaucagacguggugugcaagcccugugccccggggacguucuccaacacgacuucauccacggauauuugcaggccccaccagaucuguaacgugguggccaucccugggaaugcaagcauggaugcagucugcacguccacgucccccacccggaguauggccccaggggcaguacacuuaccccagccaguguccacacgaucccaacacacgcagccaacuccagaacccagcacugcuccaagcaccuccuuccugcucccaaugggccccagccccccagcugaagggagcacuggcgacuucgcucugccaguuggacugauugugggugugacagccuugggucuacuaauaauaggaguggugaacugugucaucaugacccaggugaaaaagaagcccuugugccugcagagagaagccaaggugccucacuugccugccgauaaggcccgggguacacagggccccgagcagcagcaccuccugaucacagcgccgagcuccagcagcagcucccuggagagcucggccagugcguuggacagaagggcgcccacucggaaccagccacaggcaccaggcguggaggccaguggggccggggaggcccgggccagcaccgggagcucagauucuuccccugguggccaugggacccaggucaaugucaccuguaucgugaacgucuguagcagcucugaccacagcucacagugcuccucccaagccagcuccacaaugggagacacagauuccagccccucggaguccccgaaggacgagcagguccccuucuccaaggaggaaugugccuuucggucacagcuggagacgccagagacccugcuggggagcaccgaagagaagccccugccccuuggagugccugaugcugggaugaagcccaguuaa

SEQ ID NO: 6009 - RNA, 1065 nt, Artificial Sequence
  derived and/or modified CDS sequence (wt) from Homo sapiens__NP_004460.1__HsVEGFD
auguacagagaguggguaguggugaauguuuucaugauguuguacguccagcuggugcagggcuccaguaaugaacauggaccagugaagcgaucaucucaguccacauuggaacgaucugaacagcagaucagggcugcuucuaguuuggaggaacuacuucgaauuacucacucugaggacuggaagcuguggagaugcaggcugaggcucaaaaguuuuaccaguauggacucucgcucagcaucccaucgguccacuagguuugcggcaacuuucuaugacauugaaacacuaaaaguuauagaugaagaauggcaaagaacucagugcagcccuagagaaacgugcguggagguggccagugagcuggggaagaguaccaacacauucuucaagcccccuugugugaacguguuccgaugugguggcuguugcaaugaagagagccuuaucuguaugaacaccagcaccucguacauuuccaaacagcucuuugagauaucagugccuuugacaucaguaccugaauuagugccuguuaaaguugccaaucauacagguuguaagugcuugccaacagccccccgccauccauacucaauuaucagaagauccauccagaucccugaagaagaucgcuguucccauuccaagaaacucuguccuauugacaugcuaugggauagcaacaaauguaaauguguuuugcaggaggaaaauccacuugcuggaacagaagaccacucucaucuccaggaaccagcucucugugggccacacaugauguuugacgaagaucguugcgagugugucuguaaaacaccaugucccaaagaucuaauccagcaccccaaaaacugcaguugcuuugagugcaaagaaagucuggagaccugcugccagaagcacaagcuauuucacccagacaccuguagcugugaggacagaugccccuuucauaccagaccaugugcaaguggcaaaacagcaugugcaaagcauugccgcuuuccaaaggagaaaagggcugcccaggggccccacagccgaaagaauccuuga

SEQ ID NO: 6010 - RNA, 751 nt, Artificial Sequence
  mRNA product Design1 comprising derived and/or modified sequence from Sus scrofa__P45561-2__SsAMELX-001-2 (wt)
gggagaaagcuuaccauggggaccuggauuuuguuugcuugccuccugggagcagccuucucuaugccucuaccaccucauccugggcacccugguuauaucaacuucagcuauauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6011 - RNA, 787 nt, Artificial Sequence
  mRNA product Design1 comprising derived and/or modified sequence from Sus scrofa__NP_998965.1__SsAMELX-001-3 (wt)
gggagaaagcuuaccauggggaccuggauuuucuuugccugccuuuugggagcaucccuugcuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6012 - RNA, 436 nt, Artificial Sequence
  mRNA product Design1 comprising derived and/or modified sequence from Sus scrofa__K7GPB2__SsAMELX-002 (wt)
gggagaaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6013 - RNA, 829 nt, Artificial Sequence
  mRNA product Design1 comprising derived and/or modified sequence from Sus scrofa__K7GLD0__SsAMELX-003 (wt)
gggagaaagcuuaccauggggaccuggauuuuguuugcuugccuccugggagcagccuucucuaugccucuaccaccucauccugggcacccugguuauaucaacuucagcuaugaggacuuauacuuggaggcuauccguauugacaggacugcauucgugcuuaccccucugaagugguaccagaacaugauaagacauccguacacuuccuaugguuacgaacccauggguggauggcugcaccaccaaaucauucccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6014 - RNA, 715 nt, Artificial Sequence
  mRNA product Design1 comprising derived and/or modified sequence from Sus scrofa__K7GPE9__SsAMELX-004 (wt)
gggagaaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6015 - RNA, 739 nt, Artificial Sequence
  mRNA product Design1 comprising derived and/or modified sequence from Sus scrofa__J9JIM4__SsAMELX-201 (wt)
gggagaaagcuuaccaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6016 - RNA, 3178 nt, Artificial Sequence
  mRNA product Design1 comprising derived and/or modified sequence from Homo sapiens__NP_006120.1__HsBMP1 (wt)
gggagaaagcuuaccaugcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcggcugccuuucuuggggacauugcccuggacgaagaggaccugagggccuuccagguacagcaggcuguggaucucagacggcacacagcucguaaguccuccaucaaagcugcaguuccaggaaacacuucuacccccagcugccagagcaccaacgggcagccucagaggggagccugugggagauggagagguagaucccguagccggcgggcggcgacgucccgaccagagcguguguggcccgauggggucauccccuuugucauugggggaaacuucacugguagccagagggcagucuuccggcaggccaugaggcacugggagaagcacaccugugucaccuuccuggagcgcacugacgaggacagcuauauuguguucaccuaucgaccuugcgggugcugcuccuacgugggucgccgcggcgggggcccccaggccaucuccaucggcaagaacugugacaaguucggcauugugguccacgagcugggccacgucgucggcuucuggcacgaacacacucggccagaccgggaccgccacguuuccaucguucgugagaacauccagccagggcaggaguauaacuuccugaagauggagccucaggagguggagucccugggggagaccuaugacuucgacagcaucaugcauuacgcucggaacacauucuccaggggcaucuuccuggauaccauuguccccaaguaugaggugaacggggugaaaccucccauuggccaaaggacacggcucagcaagggggacauugcccaagcccgcaagcuguacaagugcccagccuguggagagacccugcaagacagcacaggcaacuucuccuccccugaauaccccaauggcuacucugcucacaugcacugcguguggcgcaucucugucacacccggggagaagaucauccugaacuucacgucccuggaccuguaccgcagccgccugugcugguacgacuauguggagguccgagauggcuucuggaggaaggcgccccuccgaggccgcuucugcggguccaaacucccugagccuaucgucuccacugacagccgccucuggguugaguuccgcagcagcagcaauuggguuggaaagggcuucuuugcagucuacgaagccaucugcgggggugaugugaaaaaggacuauggccacauucaaucgcccaacuacccagacgauuaccggcccagcaaagucugcaucuggcggauccaggugucugagggcuuccacgugggccucacauuccaguccuuugagauugagcgccacgacagcugugccuacgacuaucuggaggugcgcgacgggcacagugagagcagcacccucaucgggcgcuacuguggcuaugagaagccugaugacaucaagagcacguccagccgccucuggcucaaguucgucucugacggguccauuaacaaagcgggcuuugccgucaacuuuuucaaagagguggacgagugcucucggcccaaccgcgggggcugugagcagcggugccucaacacccugggcagcuacaagugcagcugugaccccggguacgagcuggccccagacaagcgccgcugugaggcugcuuguggcggauuccucaccaagcucaacggcuccaucaccagcccgggcuggcccaaggaguacccccccaacaagaacugcaucuggcagcugguggcccccacccaguaccgcaucucccugcaguuugacuucuuugagacagagggcaaugaugugugcaaguacgacuucguggaggugcgcaguggacucacagcugacuccaagcugcauggcaaguucugugguucugagaagcccgaggucaucaccucccaguacaacaacaugcgcguggaguucaaguccgacaacaccguguccaaaaagggcuucaaggcccacuucuucucagacaaggacgagugcuccaaggauaacggcggcugccagcaggacugcgucaacacguucggcaguuaugagugccaaugccgcaguggcuucguccuccaugacaacaagcacgacugcaaagaagccggcugugaccacaaggugacauccaccagugguaccaucaccagccccaacuggccugacaaguaucccagcaagaaggagugcacgugggccaucuccagcacccccgggcaccgggucaagcugaccuucauggagauggacaucgagucccagccugagugugccuacgaccaccuagagguguucgacgggcgagacgccaaggcccccguccucggccgcuucugugggagcaagaagcccgagcccguccuggccacaggcagccgcauguuccugcgcuucuacucagauaacucgguccagcgaaagggcuuccaggccucccacgccacagagugcgggggccagguacgggcagacgugaagaccaaggaccuuuacucccacgcccaguuuggcgacaacaacuacccuggggguguggacugugagugggucauuguggccgaggaaggcuacggcguggagcucguguuccagaccuuugagguggaggaggagaccgacugcggcuaugacuacauggagcuguucgacggcuacgacagcacagcccccaggcuggggcgcuacuguggcucagggccuccugaggagguguacucggcgggagauucuguccuggugaaguuccacucggaugacaccaucaccaaaaaagguuuccaccuccgauacaccagcaccaaguuccaggacacacuccacagcaggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6017 - RNA, 1408 nt, Artificial Sequence
  mRNA product Design1 comprising derived and/or modified sequence from Homo sapiens__NP_001191.1__HsBMP2 (wt)
gggagaaagcuuaccaugguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcagaugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6018 - RNA, 1444 nt, Artificial Sequence
  mRNA product Design1 comprising derived and/or modified sequence from Homo sapiens__NP_001193.2__HsBMP4 (wt)
gggagaaagcuuaccaugauuccugguaaccgaaugcugauggucguuuuauuaugccaaguccugcuaggaggcgcgagccaugcuaguuugauaccugagacggggaagaaaaaagucgccgagauucagggccacgcgggaggacgccgcucagggcagagccaugagcuccugcgggacuucgaggcgacacuucugcagauguuugggcugcgccgccgcccgcagccuagcaagagugccgucauuccggacuacaugcgggaucuuuaccggcuucagucuggggaggaggaggaagaacagauccacagcacuggucuugaguauccugagcgcccggccagccgggccaacaccgugaggagcuuccaccacgaagaacaucuggagaacaucccagggaccagugaaaacucugcuuuucguuuccucuuuaaccucagcagcaucccugagaacgaggugaucuccucugcagagcuucggcuguuccgggagcaggucgaccagggcccugauugggaaaggggcuuccaccguauaaacauuuaugagguuaugaagcccccagcagaaguggugccugggcaccucaucacacgacuacuggacacgagacugguccaccacaaugugacacggugggaaacuuuugaugugagcccugcgguccuucgcuggacccgggagaagcagccaaacuaugggcuagccauugaggugacucaccuccaucagacucggacccaccagggccagcaugucaggauuagccgaucguuaccucaagggagugggaauugggcccagcuccggccccuccuggucaccuuuggccaugauggccggggccaugccuugacccgacgccggagggccaagcguagcccuaagcaucacucacagcgggccaggaagaagaauaagaacugccggcgccacucgcucuauguggacuucagcgaugugggcuggaaugacuggauuguggccccaccaggcuaccaggccuucuacugccauggggacugccccuuuccacuggcugaccaccucaacucaaccaaccaugccauugugcagacccuggucaauucugucaauuccaguauccccaaagccuguugugugcccacugaacugagugccaucuccaugcuguaccuggaugaguaugauaaggugguacugaaaaauuaucaggagaugguaguagagggaugugggugccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6019 - RNA, 1759 nt, Artificial Sequence
  mRNA product Design1 comprising derived and/or modified sequence from Homo sapiens__NP_001709.1__HsBMP6 (wt)
gggagaaagcuuaccaugccggggcuggggcggagggcgcaguggcugugcugguggugggggcugcugugcagcugcugcgggcccccgccgcugcggccgcccuugcccgcugccgcggccgccgccgccggggggcagcugcugggggacggcgggagccccggccgcacggagcagccgccgccgucgccgcaguccuccucgggcuuccuguaccggcggcucaagacgcaggagaagcgggagaugcagaaggagaucuugucggugcuggggcucccgcaccggccccggccccugcacggccuccaacagccgcagcccccggcgcuccggcagcaggaggagcagcagcagcagcagcagcugccucgcggagagcccccucccgggcgacugaaguccgcgccccucuucaugcuggaucuguacaacgcccuguccgccgacaacgacgaggacggggcgucggagggggagaggcagcaguccuggccccacgaagcagccagcucgucccagcgucggcagccgcccccgggcgccgcgcacccgcucaaccgcaagagccuucuggcccccggaucuggcagcggcggcgcguccccacugaccagcgcgcaggacagcgccuuccucaacgacgcggacauggucaugagcuuugugaaccugguggaguacgacaaggaguucuccccucgucagcgacaccacaaagaguucaaguucaacuuaucccagauuccugagggugagguggugacggcugcagaguuccgcaucuacaaggacuguguuauggggaguuuuaaaaaccaaacuuuucuuaucagcauuuaucaagucuuacaggagcaucagcacagagacucugaccuguuuuuguuggacacccguguaguaugggccucagaagaaggcuggcuggaauuugacaucacggccacuagcaaucuguggguugugacuccacagcauaacauggggcuucagcugagcguggugacaagggauggaguccacguccacccccgagccgcaggccuggugggcagagacggcccuuacgacaagcagcccuucaugguggcuuucuucaaagugagugaggugcacgugcgcaccaccaggucagccuccagccggcgccgacaacagagucguaaucgcucuacccagucccaggacguggcgcgggucuccagugcuucagauuacaacagcagugaauugaaaacagccugcaggaagcaugagcuguaugugaguuuccaagaccugggauggcaggacuggaucauugcacccaagggcuaugcugccaauuacugugauggagaaugcuccuucccacucaacgcacacaugaaugcaaccaaccacgcgauugugcagaccuugguucaccuuaugaaccccgaguauguccccaaaccgugcugugcgccaacuaagcuaaaugccaucucgguucuuuacuuugaugacaacuccaaugucauucugaaaaaauacaggaauaugguuguaagagcuuguggaugccacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6020 - RNA, 1513 nt, Artificial Sequence
  mRNA product Design1 comprising derived and/or modified sequence from Homo sapiens__NP_001710.1__HsBMP7 (wt)
gggagaaagcuuaccaugcacgugcgcucacugcgagcugcggcgccgcacagcuucguggcgcucugggcaccccuguuccugcugcgcuccgcccuggccgacuucagccuggacaacgaggugcacucgagcuucauccaccggcgccuccgcagccaggagcggcgggagaugcagcgcgagauccucuccauuuugggcuugccccaccgcccgcgcccgcaccuccagggcaagcacaacucggcacccauguucaugcuggaccuguacaacgccauggcgguggaggagggcggcgggcccggcggccagggcuucuccuaccccuacaaggccgucuucaguacccagggccccccucuggccagccugcaagauagccauuuccucaccgacgccgacauggucaugagcuucgucaaccucguggaacaugacaaggaguucuuccacccacgcuaccaccaucgagaguuccgguuugaucuuuccaagaucccagaaggggaagcugucacggcagccgaguuccggaucuacaaggacuacauccgggaacgcuucgacaaugagacguuccggaucagcguuuaucaggugcuccaggagcacuugggcagggaaucggaucucuuccugcucgacagccguacccucugggccucggaggagggcuggcugguguuugacaucacagccaccagcaaccacuggguggucaauccgcggcacaaccugggccugcagcucucgguggagacgcuggaugggcagagcaucaaccccaaguuggcgggccugauugggcggcacgggccccagaacaagcagcccuucaugguggcuuucuucaaggccacggagguccacuuccgcagcauccgguccacggggagcaaacagcgcagccagaaccgcuccaagacgcccaagaaccaggaagcccugcggauggccaacguggcagagaacagcagcagcgaccagaggcaggccuguaagaagcacgagcuguaugucagcuuccgagaccugggcuggcaggacuggaucaucgcgccugaaggcuacgccgccuacuacugugagggggagugugccuucccucugaacuccuacaugaacgccaccaaccacgccaucgugcagacgcugguccacuucaucaacccggaaacggugcccaagcccugcugugcgcccacgcagcucaaugccaucuccguccucuacuucgaugacagcuccaacgucauccugaagaaauacagaaacauggugguccgggccuguggcugccacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6021 - RNA, 517 nt, Artificial Sequence
  mRNA product Design1 comprising derived and/or modified sequence from Homo sapiens__NP_006264.2__HsCCL7 (wt)
gggagaaagcuuaccaugaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6022 - RNA, 3841 nt, Artificial Sequence
  mRNA product Design1 comprising derived and/or modified sequence from Homo sapiens__NP_001954.2__HsEGF (wt)
gggagaaagcuuaccaugcugcucacucuuaucauucuguugccaguaguuucaaaauuuaguuuuguuagucucucagcaccgcagcacuggagcuguccugaagguacucucgcaggaaauggcaauucuacuuguguggguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccugagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcaggaggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcggagcuuucauaugcccuccuaugggacacagacccuugaagggggugucgagaagccccauucucuccuaucagcuaacccauuauggcaacaaagggcccuggacccaccacaccaaauggagcugacucagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6023 - RNA, 727 nt, Artificial Sequence
  mRNA product Design1 comprising derived and/or modified sequence from Homo sapiens__NP_001423.1__HsEREG (wt)
gggagaaagcuuaccaugaccgcggggaggaggauggagaugcucugugccggcagggucccugcgcugcugcucugccuggguuuccaucuucuacaggcaguccucaguacaacugugauuccaucauguaucccaggagaguccagugauaacugcacagcuuuaguucagacagaagacaauccacguguggcucaagugucaauaacaaaguguagcucugacaugaauggcuauuguuugcauggacagugcaucuaucugguggacaugagucaaaacuacugcagaugugaaguggguuauacugguguccgaugugaacacuucuuuuuaaccguccaccaaccuuuaagcaaagaauauguggcuuugaccgugauucuuauuauuuuguuucuuaucacagucgucgguuccacauauuauuucugcagaugguacagaaaucgaaaaaguaaagaaccaaagaaggaauaugagagaguuaccucaggggauccagaguugccgcaagucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6024 - RNA, 1084 nt, Artificial Sequence
  mRNA product Design1 comprising derived and/or modified sequence from Homo sapiens__NP_001997.5__HsFGF2 (wt)
gggagaaagcuuaccauggugggugugggggguggagauguagaagaugugacgccgcggcccggcgggugccagauuagcggacgcggugcccgcgguugcaacgggaucccgggcgcugcagcuugggaggcggcucuccccaggcggcguccgcggagacacccauccgugaaccccaggucccgggccgccggcucgccgcgcaccaggggccggcggacagaagaacggccgagcggcucgaggcugggggaccgcgggcgcggccgcgcgcugccgggcgggaggcuggggggccggggccggggccgugccccggagcgggucggaggccggggccggggccgggggacggcggcuccccgcgcggcuccagcggcucggggaucccggccgggccccgcagggaccauggcagccgggagcaucaccacgcugcccgccuugcccgaggauggcggcagcggcgccuucccgcccggccacuucaaggaccccaagcggcuguacugcaaaaacgggggcuucuuccugcgcauccaccccgacggccgaguugacgggguccgggaaaagagcgacccucacaucaagcuacaacuucaagcagaagagagaggaguugugucuaucaaaggagugugugcuaaccguuaccuggcuaugaaggaagauggaagauuacuggcuucuaaauguguuacggaugaguguuucuuuuuugaacgauuggaaucuaauaacuacaauacuuaccggucaaggaaauacaccaguugguauguggcacugaaacgaacugggcaguauaaacuuggauccaaaacaggaccugggcagaaagcuauacuuuuucuuccaaugucugcuaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6025 - RNA, 802 nt, Artificial Sequence
  mRNA product Design1 comprising derived and/or modified sequence from Homo sapiens__NP_002000.1__HsFGF7 (wt)
gggagaaagcuuaccaugcacaaauggauacugacauggauccugccaacuuugcucuacagaucaugcuuucacauuaucugucuaguggguacuauaucuuuagcuugcaaugacaugacuccagagcaaauggcuacaaaugugaacuguuccagcccugagcgacacacaagaaguuaugauuacauggaaggaggggauauaagagugagaagacucuucugucgaacacagugguaccugaggaucgauaaaagaggcaaaguaaaagggacccaagagaugaagaauaauuacaauaucauggaaaucaggacaguggcaguuggaauuguggcaaucaaagggguggaaagugaguucuaucuugcaaugaacaaggaaggaaaacucuaugcaaagaaagaaugcaaugaagauuguaacuucaaagaacuaauucuggaaaaccauuacaacacauaugcaucagcuaaauggacacacaacggaggggaaauguuuguugccuuaaaucaaaaggggauuccuguaagaggaaaaaaaacgaagaaagaacaaaaaacagcccacuuucuuccuauggcaauaacuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6026 - RNA, 2404 nt, Artificial Sequence
  mRNA product Design1 comprising derived and/or modified sequence from Homo sapiens__NP_000592.3__HsHGF (wt)
gggagaaagcuuaccaugugggugaccaaacuccugccagcccugcugcugcagcauguccuccugcaucuccuccugcuccccaucgccauccccuaugcagagggacaaaggaaaagaagaaauacaauucaugaguucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaaucccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcauggcuuggaauccaugauguccacggaagaggagaugagaaaugcaaacagguucucaauguuucccagcugguauauggcccugaaggaucagaucugguuuuaaugaagcuggccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6027 - RNA, 2143 nt, Artificial Sequence
  mRNA product Design1 comprising derived and/or modified sequence from Homo sapiens__NP_005336.3 __HsHSPA1A (wt)
gggagaaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggucagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaaaagcgccguggaggaugaggggcucaagggcaagaucagcgaggcggacaagaagaaggugcuggacaagugucaagaggucaucucguggcuggacgccaacaccuuggccgagaaggacgaguuugagcacaagaggaaggagcuggagcaggucuguaaccccaucaucagcggacuguaccagggugccgguggucccgggccugggggcuucggggcucagggucccaagggagggucugggucaggccccaccauugaggagguagauuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6028 - RNA, 2143 nt, Artificial Sequence
  mRNA product Design1 comprising derived and/or modified sequence from Homo sapiens__NP_005337.2 __HsHSPA1B (wt)
gggagaaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggucagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaaaagcgccguggaggaugaggggcucaagggcaagaucagcgaggcggacaagaagaagguucuggacaagugucaagaggucaucucguggcuggacgccaacaccuuggccgagaaggacgaguuugagcacaagaggaaggagcuggagcaggucuguaaccccaucaucagcggacuguaccagggugccgguggucccgggccuggcggcuucggggcucagggucccaagggagggucugggucaggcccuaccauugaggagguggauuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6029 - RNA, 2143 nt, Artificial Sequence
  mRNA product Design1 comprising derived and/or modified sequence from Homo sapiens__NP_005518.3 __HsHSPA1L (wt)
gggagaaagcuuaccauggcuacugccaagggaaucgccauaggcaucgaccugggcaccaccuacuccuguguggggguguuccagcacggcaagguggagaucaucgccaacgaccagggcaaccgcaccacccccagcuacguggccuucacagacaccgagcggcucauuggggaugcggccaagaaccagguagcaaugaauccccagaacacuguuuuugaugcuaaacgucugaucggcaggaaauuuaaugauccuguuguacaagcagauaugaaacuuuggccuuuucaagugauuaaugaaggaggcaagcccaaaguccuuguguccuacaaaggggagaauaaagcauucuacccugaggaaaucucuucgaugguauugacuaaguugaaggagacugcugaggccuuuuugggccacccugucaccaaugcagugauuaccgugccagccuauuucaaugacucucaacgucaggcuacuaaggaugcaggagugauugcuggacuuaaugugcuaagaaucaucaaugagcccacggcugcugccauugccuaugguuuagauaaaggaggucaaggagaacgacauguccugauuuuugaucuggguggaggcacauuugaugugucaauucugaccauagaugaugggauuuuugagguaaaggccacugcuggggacacucaccuggguggggaggacuuugacaacaggcuugugagccacuucguggaggaguucaagaggaaacacaaaaaggacaucagccagaacaagcgagccgugaggcggcugcgcaccgccugcgagagggccaagaggacccugucguccagcacccaggccaaccuagaaauugauucacuuuaugaaggcauugacuucuauacauccaucaccagagcucgauuugaagaguugugugcagaccuguuuagggguacccuggagccuguagaaaaagcgcuucgggaugccaagauggauaaggcuaaaauccaugacauuguuuuaguagggggcuccacccgcauccccaaggugcagcggcugcuucaggacuacuucaauggacgugaucucaacaagagcaucaacccugaugaggccguagcauauggggcugcgguacaagcagccauccugaugggggacaagucugagaagguacaggaccugcugcugcuggacguggcuccccugucccuggggcuggagacggcugggggcgugaugacugcccugauaaagcgcaacuccaccauccccaccaagcagacacagauuuucaccaccuacucugacaaccaacccggggugcugauccagguguaugagggcgagagggccaugacaaaggacaacaaccugcuggggcgguuugaccugacuggaaucccuccagcacccaggggaguuccucagaucgaggugacguuugacauugaugccaaugguauucucaaugucacagccacggacaagagcaccggcaaggugaacaagaucaccaucaccaaugacaagggccgccugagcaaggaggagauugagcgcaugguucuggaugcugagaaauauaaagcugaagaugagguccagagggagaaaauugcugcaaagaaugccuuagaauccuaugcuuuuaacaugaagaguguugugagugaugaagguuugaagggcaagauuagugagucugauaaaaauaaaauauuggauaaaugcaacgagcuccuuucguggcuggaggucaaucaacuggcagagaaagaugaguuugaucauaagagaaaggaauuggagcagauguguaacccuaucaucacaaaacucuaccaaggaggaugcacugggccugccugcggaacaggguaugugccuggaaggccugccacaggccccacaauugaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6030 - RNA, 2740 nt, Artificial Sequence
  mRNA product Design1 comprising derived and/or modified sequence from Homo sapiens__NP_002145.3 __HsHSPA4 (wt)
gggagaaagcuuaccaugucgguggugggcauagaccugggcuuccagagcugcuacgucgcuguggcccgcgccggcggcaucgagacuaucgcuaaugaguauagcgaccgcugcacgccggcuugcauuucuuuugguccuaagaaucguucaauuggagcagcagcuaaaagccagguaauuucuaaugcaaagaacacaguccaaggauuuaaaagauuccauggccgagcauucucugauccauuuguggaggcagaaaaaucuaaccuugcauaugauauugugcaguugccuacaggauuaacagguauaaaggugacauauauggaggaagaacgaaauuuuaccacugagcaagugacugccaugcuuuuguccaaacugaaggagacagccgaaaguguucuuaagaagccuguaguugacuguguuguuucgguuccuuguuucuauacugaugcagaaagacgaucagugauggaugcaacacagauugcuggucuuaauugcuugcgauuaaugaaugaaaccacugcaguugcucuugcauauggaaucuauaagcaggaucuuccugccuuagaagagaaaccaagaaauguaguuuuuguagacaugggccacucugcuuaucaaguuucuguaugugcauuuaauagaggaaaacugaaaguucuggccacugcauuugacacgacauugggagguagaaaauuugaugaaguguuaguaaaucacuucugugaagaauuugggaagaaauacaagcuagacauuaaguccaaaauccgugcauuauuacgacucucucaggagugugagaaacucaagaaauugaugagugcaaaugcuucagaucucccuuugagcauugaauguuuuaugaaugauguugauguaucuggaacuaugaauagaggcaaauuucuggagaugugcaaugaucucuuagcuagaguggagccaccacuucguaguguuuuggaacaaaccaaguuaaagaaagaagauauuuaugcaguggagauaguugguggugcuacacgaaucccugcgguaaaagagaagaucagcaaauuuuucgguaaagaacuuaguacaacauuaaaugcugaugaagcugucacucgaggcugugcauugcagugugccaucuuaucgccugcuuucaaagucagagaauuuucuaucacugauguaguaccauauccaauaucucugagauggaacucuccagcugaagaagggucaagugacugugaagucuuuuccaaaaaucaugcugcuccuuucucuaaaguucuuacauuuuauagaaaggaaccuuucacucuugaggccuacuacagcucuccucaggauuugcccuauccagauccugcuauagcucaguuuucaguucagaaagucacuccucagucugauggcuccaguucaaaagugaaagucaaaguucgaguaaauguccauggcauuuucaguguguccagugcaucuuuaguggagguucacaagucugaggaaaaugaggagccaauggaaacagaucagaaugcaaaggaggaagagaagaugcaaguggaccaggaggaaccacauguugaagaacaacagcagcagacaccagcagaaaauaaggcagagucugaagaaauggagaccucucaagcuggauccaaggauaaaaagauggaccaaccaccccaagccaagaaggcaaaagugaagaccaguacuguggaccugccaaucgagaaucagcuauuauggcagauagacagagagaugcucaacuuguacauugaaaaugaggguaagaugaucaugcaggauaaacuggagaaggagcggaaugaugcuaagaacgcaguggaggaauauguguaugaaaugagagacaagcugaguggugaauaugagaaguuugugagugaagaugaucguaacaguuuuacuuugaaacuggaagauacugaaaauugguuguaugaggauggagaagaccagccaaagcaaguuuauguugauaaguuggcugaauuaaaaaaucuaggucaaccuauuaagauacguuuccaggaaucugaagaacgaccaaaauuauuugaagaacuagggaaacagauccaacaguauaugaaaauaaucagcucuuucaaaaacaaggaggaccaguaugaucauuuggaugcugcugacaugacaaagguagaaaaaagcacaaaugaagcaauggaguggaugaauaacaagcuaaaucugcagaacaagcagaguuugaccauggauccaguugucaagucaaaagagauugaagcuaaaauuaaggagcugacaaguacuuguagcccuauaauuucaaagcccaaacccaaaguggaaccuccaaaagaggaacaaaaaaaugcagagcagaauggaccaguggauggacaaggagacaacccaggcccccaggcugcugagcaggguacagacacagcugugccuucggauucagacaagaagcugccugaaauggacauugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6031 - RNA, 2737 nt, Artificial Sequence
  mRNA product Design1 comprising derived and/or modified sequence from Homo sapiens__NP_055093.2 __HsHSPA4L (wt)
gggagaaagcuuaccaugucugugguuggcauugaccucggcuuucucaacugcuacauugcugucgcgagaaguggcggcaucgagaccaucgccaaugaguacagcgacagguguaccccggccuguauaucauugggaucaagaacucgagccauuggaaaugcagcaaagagccagauagucacgaacguaagaaauacaauucauggcuucaaaaagcugcaugggcgaucauuugaugaucccauugugcaaacugaaaggaucaggcuucccuaugaacugcagaaaaugccuaauggaagugcaggaguuaaggugcgguacuuagaggaagagagaccuuuugcaauugagcaaguuacuggaaugcuguuagccaagcugaaagagacuucagaaaaugcuuugaagaaaccaguggcugacugugugauuucaauuccuagcuuuuuuacugaugccgagagaagaucugugauggcugcagcccagguugcaggcuuaaauuguuuaagguugaugaaugaaacuacugcaguugcacuggcguauggaauuuauaaacaggaucuucccccauuagaugagaaaccaagaaauguaguauuuauugauaugggacauucugccuaucaggucuugguuugugcuuuuaacaaaggaaaacuuaaagucuuggcuacuaccuuugauccauauuuggguggcaggaacuuugaugaggcuuuaguagacuacuucugugaugaguucaagaccaaauauaagauaaaugugaaagaaaacucucgggccuuguugcguuuauaucaggaaugugaaaaacuaaagaagcuaaugagugcaaaugcaucagaucuuccauugaacauugaguguuucaugaaugaccuugauguuucuaguaaaaugaacagggcucaauuugaacaacugugugcuucccuuuuggccaggguugaaccaccuuuaaaagcaguaauggaacaagcuaacuuacaacgugaagacauuaguaguauagaaauuguaggaggagcaacacgaaucccugcagugaaagaacaaaucacuaaauucuuucuuaaagacauaaguaccacauuaaaugcugaugaagcuguugcaagaggaugugcguuacagugugcgauucucucaccagcauuuaaagugcgugaauuuuccauaacagaccuuguucccuauucaaucacauuaagguggaagaccucuuuugaagauggaaguggggaaugugaaguuuucuguaagaaccauccugccccauucucaaaagucauuacuuuccacaagaaggaaccauuugaacuagaagcauuuuauacuaauuuacaugaagugccuuauccugaugcaagaauugggagcuucacuauucagaauguuuuuccacagucugauggugauaguuccaaagugaagguuaaaguucguguuaacauccauggaaucuucaguguggcuagcgcaucaguaauugagaagcaaaauuuggaaggcgaucacagugaugcuccaauggagacagaaacuucauuuaaaaaugaaaacaaagauaauauggauaaaaugcagguugaucaagaagaagggcaucaaaaaugucaugcugaacacacuccagaagaggaaauugaucauacaggagccaaaacaaagucagcugucucagacaaacaagaccgauuaaaucagacacuuaaaaaaggaaaagucaaaaguauugaucuaccgauccagaguagccuauguagacaacuaggccaagaucuucucaacagcuacauugaaaaugaggggaagaugaucaugcaagauaaguuagagaaagaaagaaaugaugcuaagaaugccguugaagaauauguauaugauuuuagagacaggcugggcacugucuaugaaaaauucaucacuccagaagacuugaguaaacugucugcaguauuggaagacacagaaaauuggcuuuaugaagacggagaggaccaaccuaaacaaguuuauguggauaagcugcaagaacuaaagaaauacggccagccuauucaaaugaaguacauggagcaugaagagagaccaaaagccuuaaaugacuugggaaaaaagauccaacuugucaugaaagugauagaagcauauagaaacaaggaugaaagauaugaucaucuggauccuacugaaauggaaaagguugaaaaauguaucagugaugccaugaguuggcugaauaguaagaugaaugcacagaacaaacuaagucucacucaagauccugugguaaaaguuucagaaauaguagcaaagucaaaggaacuggauaauuucuguaaccccaucauuuacaagcccaaaccaaaagcagaaguuccugaagacaaaccaaaagcuaauagugaacacaauggcccaauggauggacagaguggaacugaaacuaaaucagauucaacaaaagacagcucacagcauacuaaauccucuggagagauggaaguggacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6032 - RNA, 2182 nt, Artificial Sequence
  mRNA product Design1 comprising derived and/or modified sequence from Homo sapiens__NP_005338.1__HsHSPA5 (wt)
gggagaaagcuuaccaugaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagaacucaacauggaucuguuccggucuacuaugaagcccguccagaaaguguuggaagauucugauuugaagaagucugauauugaugaaauuguucuuguugguggcucgacucgaaucccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaaucccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6033 - RNA, 2149 nt, Artificial Sequence
  mRNA product Design1 comprising derived and/or modified sequence from Homo sapiens__NP_002146.2__HsHSPA6 (wt)
gggagaaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccggguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccgccuauuucaaugacucgcagcgccaggccaccaaggacgcgggggccaucgcggggcucaacguguugcggaucaucaaugagcccacggcagcugccaucgccuaugggcuggaccggcggggcgcgggagagcgcaacgugcucauuuuugaccugggugggggcaccuucgaugugucgguucucuccauugacgcuggugucuuugaggugaaagccacugcuggagauacccaccugggaggagaggacuucgacaaccggcucgugaaccacuucauggaagaguuccggcggaagcaugggaaggaccugagcgggaacaagcgugcccugcgcaggcugcgcacagccugugagcgcgccaagcgcacccuguccuccagcacccaggccacccuggagauagacucccuguucgagggcguggacuucuacacguccaucacucgugcccgcuuugaggaacugugcucagaccucuuccgcagcacccuggagccgguggagaaggcccugcgggaugccaagcuggacaaggcccagauucaugacgucguccugguggggggcuccacacgcauccccaaggugcagaaguugcugcaggacuucuucaacggcaaggagcugaacaagagcaucaacccugaugaggcuguggccuauggggcugcugugcaggcggccguguugaugggggacaaaugugagaaagugcaggaucuccugcugcuggauguggcuccccugucucuggggcuggagacagcaggaggggugaugaccacgcugauccagaggaacgccacuauccccaccaagcagacccagacuuucaccaccuacucggacaaccagccuggggucuucauccagguguaugagggugagagggccaugaccaaggacaacaaccugcuggggcguuuugaacucaguggcaucccuccugccccacguggagucccccagauagaggugacuuuugacauugaugcuaauggcauccugagcgugacagccacugacaggagcacagguaaggcuaacaagaucaccaucaccaaugacaagggccggcugagcaaggaggagguggagaggaugguucaugaagccgagcaguacaaggcugaggaugaggcccagagggacagaguggcugccaaaaacucgcuggaggcccaugucuuccaugugaaagguucuuugcaagaggaaagccuuagggacaagauucccgaagaggacaggcgcaaaaugcaagacaagugucgggaaguccuugccuggcuggagcacaaccagcuggcagagaaggaggaguaugagcaucagaagagggagcuggagcaaaucugucgccccaucuucuccaggcucuauggggggccuggugucccugggggcagcaguuguggcacucaagcccgccagggggaccccagcaccggccccaucauugaggagguugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6034 - RNA, 1321 nt, Artificial Sequence
  mRNA product Design1 comprising derived and/or modified sequence from Homo sapiens__P48741__HsHSPA7 (wt)
gggagaaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccagguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccaccuauuucaguaacucgcagcgccaggccaccaaggacgcgggggccaucgcggggcucaaggugcugccgaucaucaaugaggccacggcagcagccaucgccuaugggcuggaccggcggggcgcgggaaagcgcaacgugcucauuuuugaccugggugggggcaccuucgaugugucgguucucuccauugacgccggugucuuugaggugaaagccacugcuggagauacccaccugggaggagaggacuucgacaaccggcucgugaaccacuucauggaagaguuccggcggaagcaugggaaggaccugagcgggaacaagcgugcccugcgcaggcugcgcacagccugugagcgcgccaagcgcaccccguccuccagcacccaggccacccuggagauagacucccuguucgagggcguggacuucuacaaguccaucacucgugcccgcuuugaggaacugugcucagaccucuuccgcagcacccuggagccgguggagaaggcccugcgggaugccaagcuggacaaggcccagauucaugacuucguccuggggggagggcuccacucgcauccccaaggugcagaaguugcugcaggacuucuucaacggcaaggagcugaacaagagcaucaacccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6035 - RNA, 2158 nt, Artificial Sequence
  mRNA product Design1 comprising derived and/or modified sequence from Homo sapiens__NP_006588.1 __HsHSPA8 (wt)
gggagaaagcuuaccauguccaagggaccugcaguugguauugaucuuggcaccaccuacucuuguguggguguuuuccagcacggaaaagucgagauaauugccaaugaucagggaaaccgaaccacuccaagcuaugucgccuuuacggacacugaacgguugaucggugaugccgcaaagaaucaaguugcaaugaaccccaccaacacaguuuuugaugccaaacgucugauuggacgcagauuugaugaugcuguuguccagucugauaugaaacauuggcccuuuaugguggugaaugaugcuggcaggcccaagguccaaguagaauacaagggagagaccaagagcuucuauccagaggaggugucuucuaugguucugacaaagaugaaggaaauugcagaagccuaccuugggaagacuguuaccaaugcuguggucacagugccagcuuacuuuaaugacucucagcgucaggcuaccaaagaugcuggaacuauugcuggucucaauguacuuagaauuauuaaugagccaacugcugcugcuauugcuuacggcuuagacaaaaagguuggagcagaaagaaacgugcucaucuuugaccugggagguggcacuuuugaugugucaauccucacuauugaggauggaaucuuugaggucaagucuacagcuggagacacccacuuggguggagaagauuuugacaaccgaauggucaaccauuuuauugcugaguuuaagcgcaagcauaagaaggacaucagugagaacaagagagcuguaagacgccuccguacugcuugugaacgugcuaagcguacccucucuuccagcacccaggccaguauugagaucgauucucucuaugaaggaaucgacuucuauaccuccauuacccgugcccgauuugaagaacugaaugcugaccuguuccguggcacccuggacccaguagagaaagcccuucgagaugccaaacuagacaagucacagauucaugauauuguccugguuggugguucuacucguauccccaagauucagaagcugcuccaagacuucuucaauggaaaagaacugaauaagagcaucaacccugaugaagcuguugcuuauggugcagcuguccaggcagccaucuugucuggagacaagucugagaauguucaagauuugcugcucuuggaugucacuccucuuucccuugguauugaaacugcugguggagucaugacuguccucaucaagcguaauaccaccauuccuaccaagcagacacagaccuucacuaccuauucugacaaccagccuggugugcuuauucagguuuaugaaggcgagcgugccaugacaaaggauaacaaccugcuuggcaaguuugaacucacaggcauaccuccugcaccccgagguguuccucagauugaagucacuuuugacauugaugccaaugguauacucaaugucucugcuguggacaagaguacgggaaaagagaacaagauuacuaucacuaaugacaagggccguuugagcaaggaagacauugaacguaugguccaggaagcugagaaguacaaagcugaagaugagaagcagagggacaaggugucauccaagaacucacuugaguccuaugccuucaacaugaaagcaacuguugaagaugagaaacuucaaggcaagauuaacgaugaggacaaacagaagauucuggacaaguguaaugaaauuaucaacuggcuugauaagaaucagacugcugagaaggaagaauuugaacaucaacagaaagagcuggagaaaguuugcaaccccaucaucaccaagcuguaccagagugcaggaggcaugccaggaggaaugccugggggauuuccuggugguggagcuccucccucugguggugcuuccucagggcccaccauugaagagguugauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6036 - RNA, 2257 nt, Artificial Sequence
  mRNA product Design1 comprising derived and/or modified sequence from Homo sapiens__NP_004125.3 __HsHSPA9 (wt)
gggagaaagcuuaccaugauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaaaagccagguauucucuacugccgcugauggucaaacgcaaguggaaauuaaagugugucagggugaaagagagauggcuggagacaacaaacuccuuggacaguuuacuuugauuggaaucccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaguucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucacugaagcuguucgaaauggcauacaaaaagauggcaucugagcgagaaggcucuggaaguucuggcacuggggaacaaaaggaagaucaaaaggaggaaaaacaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6037 - RNA, 2278 nt, Artificial Sequence
  mRNA product Design1 comprising derived and/or modified sequence from Homo sapiens__NP_443202.3 __HsHSPA12B (wt)
gggagaaagcuuaccauguuggcugucccggagaugggccugcaggggcuguacaucggcuccagcccggagcgguccccagugccuagcccacccggcuccccgaggacccaggaaagcugcggcauugccccccucacacccucgcagucuccaaaacccgagguccgagccccccagcaggccuccuucucuguggugguggccauugacuucggcaccacgucuaguggcuaugcuuucagcuuugccagugacccugaggccauccacaugaugaggaaaugggagggcggagacccgggcguggcccaccagaagaccccgaccugccugcugcugacuccggagggcgccuuccacagcuuuggcuacaccgcccgcgauuacuaccaugaccuggaccccgaagaggcgcgggacuggcucuacuucgagaaguucaagaugaagauccacagcgccacggaucucaccuugaagacccagcuagaggcaguaaauggaaagacgaugcccgcccuggagguguucgcccaugcccugcgcuucuucagggagcacgcccuucaggagcugagggagcagagcccaucgcugccagagaaggacacugugcgcuggguguugacggugccugccaucuggaaacagccagccaagcaguucaugcgggaggcugccuaccuggcuggacuugugucccgagagaaugcagagcagcuacucaucgcccuggagcccgaggccgccucgguauacugccgcaagcugcgccugcaccagcuccuggaccugaguggccgggccccagguggugggcgccugggugagcgccgcuccaucgacuccagcuuccgucaggcucgggagcagcugcgaaggucccgccacagccgcacguuccugguggagucaggcguaggagagcugugggcagagaugcaagcaggagaccgcuacgugguggccgacugcggcggaggcaccguggaccugacggugcaccagcuggagcagccccauggcacccucaaggagcucuacaaggcaucugggggcccuuauggcgcggugggcguggaccuggccuucgagcagcugcugugccgcaucuucggcgaggacuucaucgccaccuucaaaaggcaacggccggcagccuggguagaucugaccaucgccuucgaggcucgcaagcgcacugcuggcccacaccgugcaggggcgcucaacaucucgcugcccuucuccuucauugacuucuaccgcaagcagcggggccacaacguggagaccgcucugcgcaggagcagcgugaacuucgugaagugguccucacaggggaugcuccgaaugucuugugaagccaugaacgagcucuuucagcccaccgucagcgggaucauccagcacauagaggcccugcuggcacggccggaggugcagggugugaagcugcuguuccuagugggcggcuucgccgagucagcggugcugcagcacgcggugcaggcggcgcugggcgcccgcggucugcgugucguggucccgcacgacgugggccucaccauccucaaaggcgcggugcuguucggccaggcgccgggcguggugcggguccgccgcucgccgcucaccuauggcgugggcgugcucaaccgcuuugugccugggcgccacccgcccgaaaagcugcugguucgcgacggccgccgcuggugcaccgacgucuucgagcgcuucguggccgccgagcagucgguggcccugggcgaggaggugcggcgcagcuacugcccggcgcgucccggccagcggcgcguacucaucaaccuguacugcugcgcggcagaggaugcgcgcuucaucaccgaccccggcgugcgcaaaugcggcgcgcucagccucgagcuugagcccgccgacugcggccaggacaccgccggcgcgccucccggccgccgcgagauccgcgccgccaugcaguuuggcgacaccgaaauuaaggucaccgccgucgacgucagcaccaaucgcuccgugcgcgcguccaucgacuuucuuuccaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6038 - RNA, 1747 nt, Artificial Sequence
  mRNA product Design1 comprising derived and/or modified sequence from Homo sapiens__NP_057383.2__HsHSPA14 (wt)
gggagaaagcuuaccauggcggccaucggaguucaccugggcugcaccucagccuguguggccgucuauaaggauggccgggcuggugugguugcaaaugaugccggugaccgaguuacuccagcuguuguugcuuacucagaaaaugaagagauuguuggauuggcagcaaaacaaaguagaauaagaaauauuucaaauacaguaaugaaaguaaagcagauccugggcagaagcuccagugauccacaagcucagaaauacaucgcggaaaguaaauguuuagucauugaaaaaaaugggaaauuacgauaugaaauagauacuggagaagaaacaaaauuuguuaacccagaagauguugccagacugauauuuaguaaaaugaaagaaacggcacauucuguauugggcucagaugcaaaugauguaguuauuacugucccguuugauuuuggagaaaagcaaaaaaaugcucuuggagaagcagcuagagcugcuggauuuaauguuuugcgauuaauucacgaaccgucugcagcucugcuugcuuauggaauuggacaagacuccccuacuggaaaaagcaauauuuugguguuuaagcugggaggaacauccuuaucucucagcgucauggaaguuaacaguggaauauaucggguucuuucaacaaacacugaugauaacaucgguggugcacauuucacagaaaccuuagcacaguaucuagcuucugaguuccaaagauccuucaaacaugaugugagaggaaaugcgcgagccaugaugaaauuaacgaacagugcugaaguagcgaaacauucuuugucaaccuugggaagugccaacuguuuucuugacucauuauaugaaggucaagauuuugauugcaauguguccagagcaagauuugaacuucuuuguucuccacuuuuuaauaaguguauagaagcaaucagaggacucuuagaucaaaauggauuuacagcagaugauaucaacaagguuguccuuuguggagggucuucucgaaucccaaagcuacagcaacugauuaaagaucuuuucccagcuguugagcuucucaauucuaucccuccugaugaagugaucccuauuggugcagcuauagaagcaggaauccuuauugggaaagaaaaccuguugguggaagacucucuuaugauagaguguucagccagagauauuuuaguuaaggguguggacgaaucaggagccaguagauucacagugcuguuuccaucagggacuccuuugccagcucgaagacaacacacauugcaagccccuggaagcauaucuucagugugccuugaacucuaugagucugaugggaagaacucugccaaagaggaaaccaaguuugcacagguuguacuccaggauuuagauaaaaaagaaaauggauuacgugauauauuagcuguucuuacuaugaaaagggauggaucuuuacaugugacaugcacagaucaagaaacuggaaaaugugaagcaaucucuauugagauagcaucuuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6039 - RNA, 2794 nt, Artificial Sequence
  mRNA product Design1 comprising derived and/or modified sequence from Homo sapiens__NP_006635.2 __HsHSPH1 (wt)
gggagaaagcuuaccaugucgguggugggguuggacgugggcucgcagagcugcuacaucgcgguagcccgggccgggggcaucgagaccaucgccaaugaguucagcgaccggugcaccccgucagucauaucauuuggaucaaaaaauagaacaaucggaguugcagccaaaaaucagcaaaucacucaugcaaacaauacggugucuaacuucaaaagauuucauggccgagcauucaaugaccccuucauucaaaaggagaaggaaaacuugaguuacgauuugguuccauugaaaaaugguggaguuggaauaaagguaauguacaugggugaagaacaucuauuuaguguggagcagauaacagccauguuguugacuaagcugaaggaaacugcugaaaacagccucaagaaaccaguaacagauuguguuauuucaguccccuccuucuuuacagaugcugagaggcgaucuguguuagaugcugcacagauuguuggccuaaacuguuuaagacuuaugaaugacaugacagcuguugcuuugaauuacggaauuuauaagcaggaucucccaagccuggaugagaaaccucggauagugguuuuuguugauaugggacauucagcuuuucaagugucugcuugugcuuuuaacaagggaaaauugaagguacugggaacagcuuuugauccuuucuuaggaggaaaaaacuucgaugaaaaguuaguggaacauuuuugugcagaauuuaaaacuaaguacaaguuggaugcaaaauccaaaauacgagcacuccuacgucuguaucaggaaugugaaaaacugaaaaagcuaaugagcucuaacagcacagaccuuccacugaauaucgaaugcuuuaugaaugauaaagauguuuccggaaagaugaacaggucacaauuugaagaacucugugcugaacuucugcaaaagauagaaguaccccuuuauucacuguuggaacaaacucaucucaaaguagaagaugugagugcaguugagauuguuggaggcgcuacacgaaucccagcugugaaggaaagaauugccaaauucuuuggaaaagauauuagcacaacacucaaugcagaugaagcaguagccagaggaugugcauuacagugugcaauacuuuccccggcauuuaaaguuagagaauuuuccgucacagaugcaguuccuuuuccaauaucucugaucuggaaccaugauucagaagauacugaagguguucaugaagucuuuagucgaaaccaugcugcuccuuucuccaaaguucucaccuuucugagaagggggccuuuugagcuagaagcauucuauucugauccccaaggaguuccauauccagaagcaaaaauaggccgcuuuguaguucagaauguuucugcacagaaagauggagaaaaaucuagaguaaaagucaaagugcgagucaacacccauggcauuuucaccaucucuacggcaucuaugguggagaaagucccaacugaggagaaugaaaugucuucugaagcugacauggagugucugaaucagagaccaccagaaaacccagacacugauaaaaauguccagcaagacaacagugaagcuggaacacagccccagguacaaacugaugcucaacaaaccucacagucucccccuucaccugaacuuaccucagaagaaaacaaaaucccagaugcugacaaagcaaaugaaaaaaaaguugaccagccuccagaagcuaaaaagcccaaaauaaagguggugaauguugagcugccuauugaagccaacuuggucuggcaguuagggaaagaccuucuuaacauguauauugagacagaggguaagaugauaaugcaagauaaauuggaaaaagaaaggaaugaugcuaaaaaugcaguugaggaauauguguaugaguucagagacaagcuguguggaccauaugaaaaauuuauaugugagcaggaucaucaaaauuuuuugagacuccucacagaaacugaagacuggcuguaugaagaaggagaggaccaagcuaaacaagcauauguugacaaguuggaagaauuaaugaaaauuggcacuccaguuaaaguucgguuucaggaagcugaagaacggccaaaaauguuugaagaacuaggacagaggcugcagcauuaugccaagauagcagcugacuucagaaauaaggaugagaaauacaaccauauugaugagucugaaaugaaaaaaguggagaagucuguuaaugaagugauggaauggaugaauaaugucaugaaugcucaggcuaaaaagagucuugaucaggauccaguuguacgugcucaggaaauuaaaacaaaaaucaaggaauugaacaacacaugugaacccguuguaacacaaccgaaaccaaaaauugaaucacccaaacuggaaagaacuccaaauggcccaaauauugauaaaaaggaagaagauuuagaagacaaaaacaauuuuggugcugaaccuccacaucagaauggugaauguuacccuaaugagaaaaauucuguuaauauggacuuggacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6040 - RNA, 3217 nt, Artificial Sequence
  mRNA product Design1 comprising derived and/or modified sequence from Homo sapiens__NP_006380.1 __HsHYOU1 (wt)
gggagaaagcuuaccauggcagacaaaguuaggaggcagaggccgaggaggcgagucuguugggccuugguggcugugcucuuggcagaccuguuggcacugagugauacacuggcagugaugucuguggaccugggcagugaguccaugaagguggccauugucaaaccuggagugcccauggaaauugucuugaauaaggaaucucggaggaaaacaccggugaucgugacccugaaagaaaaugaaagauucuuuggagacagugcagcaagcauggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgcagcugcaguucucaccugaggaaguguugggcaugguucucaauuauucucguucucuagcugaagauuuugcagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccagaauaucauguucuaugacaugggcucaggcagcaccguaugcaccauugugaccuaccagauggugaagacuaaggaagcugggaugcagccacagcugcagauccggggaguaggauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacagauugaaggccugauggaugauguggacuucaaggcaaaagugacucguguggaauuugaggaguugugugcagacuuguuugagcgggugccugggccuguacagcaggcccuccagagugccgaaaugagucuggaugagauugagcaggucauccugguggguggggccacucggguccccagaguucaggaggugcugcugaaggccgugggcaaggaggagcuggggaagaacaucaaugcagaugaagcagccgccaugggggcaguguaccaggcagcugcgcucagcaaagccuuuaaagugaagccauuugucguccgagaugcaguggucuaccccauccugguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggguauuuggcucccagaaucugaccacagugaagcuaaaaggggugggugacagcuucaagaaguauccugacuacgaguccaagggcaucaaggcucacuucaaccuggaugagaguggcgugcucagucuagacaggguggagucuguauuugagacacugguagaggacagcgcagaagaggaaucuacucucaccaaacuuggcaacaccauuuccagccuguuuggaggcgguaccacaccagaugccaaggagaaugguacugauacuguccaggaggaagaggagagcccugcagaggggagcaaggacgagccuggggagcaggucgagcucaaggaggaagcugaggccccaguggaggauggcucucagcccccacccccugaaccuaagggagaugcaaccccugagggagaaaaggccacagaaaaagaaaauggggacaagucugaggcccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaacuucaggacuugacacuccgagaccuggagaagcaggaacgggaaaaagcugccaacagcuuggaagcauucauauuugagacccaggacaagcuguaccagcccgaguaccaggaaguguccacagaggagcagcgugaggagaucucugggaagcucagcgccgcauccaccuggcuggaggaugaggguguuggagccaccacagugauguugaaggagaagcuggcugagcugaggaagcugugccaagggcuguuuuuucggguagaggagcgcaagaaguggcccgaacggcugucugcccucgauaaucuccucaaccauuccagcauguuccucaagggggcccggcucaucccagagauggaccagaucuucacugagguggagaugacaacguuagagaaagucaucaaugagaccugggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggccagacugaagaugcagagcccauuucagaaccugagaaaguagagacuggauccgagccaggagacacugagccuuuggaguuaggagguccuggagcagaaccugaacagaaagaacaaucgacaggacagaagcggccuuugaagaacgacgaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6041 - RNA, 2416 nt, Artificial Sequence
  mRNA product Design1 comprising derived and/or modified sequence from Homo sapiens__NP_005339.3 __HsHSP90AA1 (wt)
gggagaaagcuuaccaugccugaggaaacccagacccaagaccaaccgauggaggaggaggagguugagacguucgccuuucaggcagaaauugcccaguugaugucauugaucaucaauacuuucuacucgaacaaagagaucuuucugagagagcucauuucaaauucaucagaugcauuggacaaaauccgguaugagagcuugacagaucccaguaaauuagacucugggaaagagcugcauauuaaccuuauaccgaacaaacaagaucgaacucucacuauuguggauacuggaauuggaaugaccaaggcugacuugaucaauaaccuugguacuaucgccaagucugggaccaaagcguucauggaagcauugcaggcuggugcagauaucucuaugauuggccaguucgguguugguuuuuauucugcuuauuugguugcugagaaaguaacugugaucaccaaacauaacgaugaugagcaguacgcuugggaguccucagcagggggaucauucacagugaggacagacacaggugaaccuaugggucguggaacaaaaguuauccuacaccugaaagaagaccaaacugaguacuuggaggaacgaagaauaaaggagauugugaagaaacauucucaguuuauuggauaucccauuacucuuuuuguggagaaggaacgugauaaagaaguaagcgaugaugaggcugaagaaaaggaagacaaagaagaagaaaaagaaaaagaagagaaagagucggaagacaaaccugaaauugaagauguugguucugaugaggaagaagaaaagaaggauggugacaagaagaagaagaagaagauuaaggaaaaguacaucgaucaagaagaacucaacaaaacaaagcccaucuggaccagaaaucccgacgauauuacuaaugaggaguacggagaguucuauaagagcuugaccaaugacugggaagaucacuuggcagugaagcauuuuucaguugaaggacaguuggaguucagagcccuucuauuugucccacgacgugcuccuuuugaucuguuugaaaacagaaagaaaaagaacaacaucaaauuguauguacgcagaguuuucaucauggauaacugugaggagcuaaucccugaauaucugaacuucauuagaggggugguagacucggaggaucucccucuaaacauaucccgugagauguugcaacaaagcaaaauuuugaaaguuaucaggaagaauuuggucaaaaaaugcuuagaacucuuuacugaacuggcggaagauaaagagaacuacaagaaauucuaugagcaguucucuaaaaacauaaagcucggaauacacgaagacucucaaaaucggaagaagcucucagagcuguuaagguacuacacaucugccucuggugaugagaugguuucucucaaggacuacugcaccagaaugaaggagaaccagaaacauaucuauuauaucacaggugagaccaaggaccagguagcuaacucagccuuuguggaacgucuucggaaacauggcuuagaagugaucuauaugauugagcccauugaugaguacuguguccaacagcugaaggaauuugaggggaagacuuuagugucagucaccaaagaaggccuggaacuuccagaggaugaagaagagaaaaagaagcaggaagagaaaaaaacaaaguuugagaaccucugcaaaaucaugaaagacauauuggagaaaaaaguugaaaaggugguugugucaaaccgauuggugacaucuccaugcuguauugucacaagcacauauggcuggacagcaaacauggagagaaucaugaaagcucaagcccuaagagacaacucaacaauggguuacauggcagcaaagaaacaccuggagauaaacccugaccauuccauuauugagaccuuaaggcaaaaggcagaggcugauaagaacgacaagucugugaaggaucuggucaucuugcuuuaugaaacugcgcuccugucuucuggcuucagucuggaagauccccagacacaugcuaacaggaucuacaggaugaucaaacuuggucuggguauugaugaagaugacccuacugcugaugauaccagugcugcuguaacugaagaaaugccaccccuugaaggagaugacgacacaucacgcauggaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6042 - RNA, 556 nt, Artificial Sequence
  mRNA product Design1 comprising derived and/or modified sequence from Homo sapiens__NG_005218__HsHSP90AA3P (wt)
gggagaaagcuuaccauggauuccaguaaauuagacucugggaaagggcugcauauuaaccuuguaccaaacaaacaaaaucaaacccucacuauuguggacacuagaauuggaaugaccaagacugacuugaucaauaaccucgguacugucaccaagucugggaccaaagcauucauggaagcauugcaggcugaugcagauaucucuaugauuggccauuucgggguugguuuuuauucugcuuauuugguugccaagaaaguaacugugaucagcaaacauaacaaugaugagcaguacaccugggaguccucagcagggggaucauucacagugaggacagacgagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6043 - RNA, 2392 nt, Artificial Sequence
  mRNA product Design1 comprising derived and/or modified sequence from Homo sapiens__NP_031381.2__HsHSP90AB1 (wt)
gggagaaagcuuaccaugccugaggaagugcaccauggagaggaggagguggagacuuuugccuuucaggcagaaauugcccaacucaugucccucaucaucaauaccuucuauuccaacaaggagauuuuccuucgggaguugaucucuaaugcuucugaugccuuggacaagauucgcuaugagagccugacagacccuucgaaguuggacagugguaaagagcugaaaauugacaucauccccaacccucaggaacguacccugacuuugguagacacaggcauuggcaugaccaaagcugaucucauaaauaauuugggaaccauugccaagucugguacuaaagcauucauggaggcucugcaggcuggugcagacaucuccaugauugggcaguuugguguuggcuuuuauucugccuacuugguggcagagaaagugguugugaucacaaagcacaacgaugaugaacaguaugcuugggagucuucugcuggagguuccuucacugugcgugcugaccauggugagcccauuggcagggguaccaaagugauccuccaucuuaaagaagaucagacagaguaccuagaagagaggcgggucaaagaaguagugaagaagcauucucaguucauaggcuaucccaucacccuuuauuuggagaaggaacgagagaaggaaauuagugaugaugaggcagaggaagagaaaggugagaaagaagaggaagauaaagaugaugaagaaaaacccaagaucgaagauguggguucagaugaggaggaugacagcgguaaggauaagaagaagaaaacuaagaagaucaaagagaaauacauugaucaggaagaacuaaacaagaccaagccuauuuggaccagaaacccugaugacaucacccaagaggaguauggagaguucuacaagagccucacuaaugacugggaagaccacuuggcagucaagcacuuuucuguagaaggucaguuggaguucagggcauugcuauuuauuccucgucgggcucccuuugaccuuuuugagaacaagaagaaaaagaacaacaucaaacucuauguccgccguguguucaucauggacagcugugaugaguugauaccagaguaucucaauuuuauccguggugugguugacucugaggaucugccccugaacaucucccgagaaaugcuccagcagagcaaaaucuugaaagucauucgcaaaaacauuguuaagaagugccuugagcuguucucugagcuggcagaagacaaggagaauuacaagaaauucuaugaggcauucucuaaaaaucucaagcucggaauccacgaagacuccacuaaccgccgccgccugucugagcugcugcgcuaucauaccucccagucuggagaugagaugacaucucugucagaguauguuucucgcaugaaggagacacagaaguccaucuauuacaucacuggugagagcaaagagcaggucgccaacucagcuuuuguggagcgagugcggaaacggggcuucgaggugguauauaugaccgagcccauugacgaguacugugugcagcagcucaaggaauuugaugggaaaagccuggucucaguuaccaaggagggucuggagcugccugaggaugaggaggagaagaagaagauggaagagagcaaggcaaaguuugagaaccucugcaagcucaugaaagaaaucuuagauaagaagguugagaaggugacaaucuccaauagacuugugucuucaccuugcugcauugugaccagcaccuacggcuggacagccaauauggagcggaucaugaaagcccaggcacuucgggacaacuccaccaugggcuauaugauggccaaaaagcaccuggagaucaacccugaccaccccauuguggagacgcugcggcagaaggcugaggccgacaagaaugauaaggcaguuaaggaccugguggugcugcuguuugaaaccgcccugcuaucuucuggcuuuucccuugaggauccccagacccacuccaaccgcaucuaucgcaugaucaagcuaggucuagguauugaugaagaugaaguggcagcagaggaacccaaugcugcaguuccugaugagauccccccucucgagggcgaugaggaugcgucucgcauggaagaagucgauuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6044 - RNA, 2629 nt, Artificial Sequence
  mRNA product Design1 comprising derived and/or modified sequence from Homo sapiens__NP_003290.1__HsHSP90B1 (wt)
gggagaaagcuuaccaugagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcauucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcugguucguaaaacgcuggacaugaucaagaagauugcugaugauaaauacaaugauacuuuuuggaaagaauuugguaccaacaucaagcugggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagaacccgaagaagaaccugaagagacagcagaagacacaacagaagacacagagcaagacgaagaugaagaaauggaugugggaacagaugaagaagaagaaacagcaaaggaaucuacagcugaaaaagaugaauuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6045 - RNA, 2332 nt, Artificial Sequence
  mRNA product Design1 comprising derived and/or modified sequence from Homo sapiens__NP_057376.2__HsTRAP1 (wt)
gggagaaagcuuaccauggcgcgcgagcugcgggcgcugcugcuguggggccgccgccugcggccuuugcugcgggcgccggcgcuggcggccgugccgggaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguuccacuuccaaacaugaguuccaggccgagacaaagaagcuguuggacauuguugcccggucccuguacucagaaaaagagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccaggauacugguaucgggaugacacaggaagaacugguguccaaccuggggacgauugccagaucggggucaaaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugguucuggaguguuugaaaucgccgaagcaucgggaguuagaaccgggacaaaaaucaucauccaccugaaauccgacugcaaggaguuuuccagcgaggcccgggugcgagaugugguaacgaaguacagcaacuucgucagcuuccccuuguacuugaauggaaggcggaugaacaccuugcaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacaugaaaccguccauguuugaugugagccgggagcugggcuccagcguugcacuguacagccgcaaaguccucauccagaccaaggccacggacauccugcccaaguggcugcgcuucauccgaggugugguggacagugaggacauuccccugaaccucagccgggagcugcugcaggagagcgcacucaucaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagagguucucuucugcuuugagcaguuugaugagcucacccugcugcaccuucgugaguuugacaagaagaagcugaucucuguggagacggacauagucguggaucacuacaaggaggagaaguuugaggacagguccccagccgccgagugccuaucagagaaggagacggaggagcucauggccuggaugagaaaugugcuggggucgcgugucaccaacgugaaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggcacgcgcucaucaagaagcugaaucagcugcgcgcaagcgagccuggccuggcucagcugcugguggaucagauauacgagaacgccaugauugcugcuggacuuguugacgacccuagggccauggugggccgcuugaaugagcugcuugucaaggcccuggagcgacacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6046 - RNA, 679 nt, Artificial Sequence
  mRNA product Design1 comprising derived and/or modified sequence from Homo sapiens__NP_000609.1__HsIGF1 (wt)
gggagaaagcuuaccaugggaaaaaucagcagucuuccaacccaauuauuuaagugcugcuuuugugauuucuugaaggugaagaugcacaccauguccuccucgcaucucuucuaccuggcgcugugccugcucaccuucaccagcucugccacggcuggaccggagacgcucugcggggcugagcugguggaugcucugcaguucguguguggagacaggggcuuuuauuucaacaagcccacaggguauggcuccagcagucggagggcgccucagacaggcaucguggaugagugcugcuuccggagcugugaucuaaggaggcuggagauguauugcgcaccccucaagccugccaagucagcucgcucuguccgugcccagcgccacaccgacaugcccaagacccagaaggaaguacauuugaagaacgcaaguagagggagugcaggaaacaagaacuacaggauguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6047 - RNA, 856 nt, Artificial Sequence
  mRNA product Design1 comprising derived and/or modified sequence from Homo sapiens__NP_000591.1__HsIL6 (wt)
gggagaaagcuuaccaugaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcugugcagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucugcggcaaauguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6048 - RNA, 1498 nt, Artificial Sequence
  mRNA product Design1 comprising derived and/or modified sequence from Homo sapiens__NP_002183.1__HsINHBA (wt)
gggagaaagcuuaccaugcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcugcaugugggcaaagucggggagaacggguauguggagauagaggaugacauuggaaggagggcagaaaugaaugaacuuauggagcagaccucggagaucaucacguuugccgagucaggaacagccaggaagacgcugcacuucgagauuuccaaggaaggcagugaccugucagugguggagcgugcagaagucuggcuguuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaaaagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6049 - RNA, 3676 nt, Artificial Sequence
  mRNA product Design1 comprising derived and/or modified sequence from Homo sapiens__NP_000623.2__HsITGAM (wt)
gggagaaagcuuaccauggcucucagaguccuucuguuaacagccuugaccuuaugucauggguucaacuuggacacugaaaacgcaaugaccuuccaagagaacgcaaggggcuucgggcagagcgugguccagcuucagggauccaggguggugguuggagccccccaggagauaguggcugccaaccaaaggggcagccucuaccagugcgacuacagcacaggcucaugcgagcccauccgccugcagguccccguggaggccgugaacaugucccugggccugucccuggcagccaccaccagccccccucagcugcuggccuguggucccaccgugcaccagacuugcagugagaacacguaugugaaagggcucugcuuccuguuuggauccaaccuacggcagcagccccagaaguucccagaggcccuccgaggguguccucaagaggauagugacauugccuucuugauugauggcucugguagcaucaucccacaugacuuucggcggaugaaggaguuugucucaacugugauggagcaauuaaaaaaguccaaaaccuuguucucuuugaugcaguacucugaagaguuccggauucacuuuaccuucaaagaguuccagaacaacccuaacccaagaucacuggugaagccaauaacgcagcugcuugggcggacacacacggccacgggcauccgcaaagugguacgagagcuguuuaacaucaccaacggagcccgaaagaaugccuuuaagauccuaguugucaucacggauggagaaaaguuuggcgaucccuugggauaugaggaugucaucccugaggcagacagagagggagucauucgcuacgucauuggggugggagaugccuuccgcagugagaaaucccgccaagagcuuaauaccaucgcauccaagccgccucgugaucacguguuccaggugaauaacuuugaggcucugaagaccauucagaaccagcuucgggagaagaucuuugcgaucgaggguacucagacaggaaguagcagcuccuuugagcaugagaugucucaggaaggcuucagcgcugccaucaccucuaauggccccuugcugagcacuguggggagcuaugacugggcugguggagucuuucuauauacaucaaaggagaaaagcaccuucaucaacaugaccagaguggauucagacaugaaugaugcuuacuuggguuaugcugccgccaucaucuuacggaaccgggugcaaagccugguucugggggcaccucgauaucagcacaucggccugguagcgauguucaggcagaacacuggcaugugggaguccaacgcuaaugucaagggcacccagaucggcgccuacuucggggccucccucugcuccguggacguggacagcaacggcagcaccgaccugguccucaucggggccccccauuacuacgagcagacccgagggggccagguguccgugugccccuugcccagggggagggcucgguggcagugugaugcuguucucuacggggagcagggccaacccuggggccgcuuuggggcagcccuaacagugcugggggacguaaauggggacaagcugacggacguggccauuggggccccaggagaggaggacaaccggggugcuguuuaccuguuucacggaaccucaggaucuggcaucagccccucccauagccagcggauagcaggcuccaagcucucucccaggcuccaguauuuuggucagucacugagugggggccaggaccucacaauggauggacugguagaccugacuguaggagcccaggggcacgugcugcugcucaggucccagccaguacugagagucaaggcaaucauggaguucaaucccagggaaguggcaaggaauguauuugaguguaaugaucagguggugaaaggcaaggaagccggagaggucagagucugccuccauguccagaaaagcacacgggaucggcuaagagaaggacagauccagaguguugugacuuaugaccuggcucuggacuccggccgcccacauucccgcgccgucuucaaugagacaaagaacagcacacgcagacagacacaggucuuggggcugacccagacuugugagacccugaaacuacaguugccgaauugcaucgaggacccagugagccccauugugcugcgccugaacuucucucuggugggaacgccauugucugcuuucgggaaccuccggccagugcuggcggaggaugcucagagacucuucacagccuuguuucccuuugagaagaauuguggcaaugacaacaucugccaggaugaccucagcaucaccuucaguuucaugagccuggacugccucguggugggugggccccgggaguucaacgugacagugacugugagaaaugauggugaggacuccuacaggacacaggucaccuucuucuucccgcuugaccuguccuaccggaagguguccacgcuccagaaccagcgcucacagcgauccuggcgccuggccugugagucugccuccuccaccgaagugucuggggccuugaaaagcaccagcugcagcauaaaccaccccaucuucccggaaaacucagaggucaccuuuaauaucacguuugauguagacucuaaggcuucccuuggaaacaaacugcuccucaaggccaaugugaccagugagaacaacaugcccagaaccaacaaaaccgaguuccaacuggagcugccggugaaauaugcugucuacaugguggucaccagccauggggucuccacuaaauaucucaacuucacggccucagagaauaccagucgggucaugcagcaucaauaucaggucagcaaccuggggcagaggagccuccccaucagccugguguucuuggugcccguccggcugaaccagacugucauaugggaccgcccccaggucaccuucuccgagaaccucucgaguacgugccacaccaaggagcgcuugcccucucacuccgacuuucuggcugagcuucggaaggcccccguggugaacugcuccaucgcugucugccagagaauccagugugacaucccguucuuuggcauccaggaagaguucaaugcuacccucaaaggcaaccucucguuugacugguacaucaagaccucgcauaaccaccuccugaucgugagcacagcugagaucuuguuuaacgauuccguguucacccugcugccgggacagggggcguuugugaggucccagacggagaccaaaguggagccguucgagguccccaacccccugccgcucaucgugggcagcucugucgggggacugcugcuccuggcccucaucaccgccgcgcuguacaagcucggcuucuucaagcggcaauacaaggacaugaugagugaagggggucccccgggggccgaaccccaguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6050 - RNA, 1621 nt, Artificial Sequence
  mRNA product Design1 comprising derived and/or modified sequence from Homo sapiens__NP_002415.1__HsMMP8 (wt)
gggagaaagcuuaccauguucucccugaagacgcuuccauuucugcucuuacuccaugugcagauuuccaaggccuuuccuguaucuucuaaagagaaaaauacaaaaacuguucaggacuaccuggaaaaguucuaccaauuaccaagcaaccaguaucagucuacaaggaagaauggcacuaaugugaucguugaaaagcugaaagaaaugcagcgauuuuuuggguugaaugugacggggaagccaaaugaggaaacucuggacaugaugaaaaagccucgcuguggagugccugacaguggugguuuuauguuaaccccaggaaaccccaagugggaacgcacuaacuugaccuacaggauucgaaacuauaccccacagcugucagaggcugagguagaaagagcuaucaaggaugccuuugaacucuggaguguugcaucaccucucaucuucaccaggaucucacagggagaggcagauaucaacauugcuuuuuaccaaagagaucacggugacaauucuccauuugauggacccaauggaauccuugcucaugccuuucagccaggccaagguauuggaggagaugcucauuuugaugccgaagaaacauggaccaacaccuccgcaaauuacaacuuguuucuuguugcugcucaugaauuuggccauucuuuggggcucgcucacuccucugacccuggugccuugauguaucccaacuaugcuuucagggaaaccagcaacuacucacucccucaagaugacaucgauggcauucaggccaucuauggacuuucaagcaacccuauccaaccuacuggaccaagcacacccaaacccugugaccccaguuugacauuugaugcuaucaccacacuccguggagaaauacuuuucuuuaaagacagguacuucuggagaaggcauccucagcuacaaagagucgaaaugaauuuuauuucucuauucuggccaucccuuccaacugguauacaggcugcuuaugaagauuuugacagagaccucauuuuccuauuuaaaggcaaccaauacugggcucugaguggcuaugauauucugcaagguuaucccaaggauauaucaaacuauggcuuccccagcagcguccaagcaauugacgcagcuguuuucuacagaaguaaaacauacuucuuuguaaaugaccaauucuggagauaugauaaccaaagacaauucauggagccagguuaucccaaaagcauaucaggugccuuuccaggaauagagaguaaaguugaugcaguuuuccagcaagaacauuucuuccaugucuucaguggaccaagauauuacgcauuugaucuuauugcucagagaguuaccagaguugcaagaggcaauaaauggcuuaacuguagauauggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6051 - RNA, 2341 nt, Artificial Sequence
  mRNA product Design1 comprising derived and/or modified sequence from Homo sapiens__NP_004985.2__HsMMP9 (wt)
gggagaaagcuuaccaugagccucuggcagccccugguccuggugcuccuggugcugggcugcugcuuugcugcccccagacagcgccaguccacccuugugcuguucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcuguucggcuucugcccgacccgagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuguucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6052 - RNA, 1285 nt, Artificial Sequence
  mRNA product Design1 comprising derived and/or modified sequence from Homo sapiens__NP_001286.1__HsCCR1 (wt)
gggagaaagcuuaccauggaaacuccaaacaccacagaggacuaugacacgaccacagaguuugacuauggggaugcaacuccgugccagaaggugaacgagagggccuuuggggcccaacugcugcccccucuguacuccuugguauuugucauuggccugguuggaaacauccuggugguccugguccuugugcaauacaagaggcuaaaaaacaugaccagcaucuaccuccugaaccuggccauuucugaccugcuguuccuguucacgcuucccuucuggaucgacuacaaguugaaggaugacuggguuuuuggugaugccauguguaagauccucucuggguuuuauuacacaggcuuguacagcgagaucuuuuucaucauccugcugacgauugacagguaccuggccaucguccacgccguguuugccuugcgggcacggaccgucacuuuuggugucaucaccagcaucaucauuugggcccuggccaucuuggcuuccaugccaggcuuauacuuuuccaagacccaaugggaguucacucaccacaccuguagccuucacuuuccucacgaaagccuacgagaguggaagcuguuucaggcucugaaacugaaccucuuugggcugguauugccuuuguuggucaugaucaucugcuacacagggauuauaaagauucugcuaagacgaccaaaugagaagaaauccaaagcuguccguuugauuuuugucaucaugaucaucuuuuuucucuuuuggacccccuacaauuugacuauacuuauuucuguuuuccaagacuuccuguucacccaugagugugagcagagcagacauuuggaccuggcugugcaagugacggaggugaucgccuacacgcacugcugugucaacccagugaucuacgccuucguuggugagagguuccggaaguaccugcggcaguuguuccacaggcguguggcugugcaccugguuaaauggcuccccuuccucuccguggacaggcuggagagggucagcuccacaucucccuccacaggggagcaugaacucucugcuggguucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6053 - RNA, 943 nt, Artificial Sequence
  mRNA product Design1 comprising derived and/or modified sequence from Homo sapiens__NP_002599.1__HsPDGFB (wt)
gggagaaagcuuaccaugaaucgcugcugggcgcuguuccugucucucugcugcuaccugcgucuggucagcgccgagggggaccccauucccgaggagcuuuaugagaugcugagugaccacucgauccgcuccuuugaugaucuccaacgccugcugcacggagaccccggagaggaagauggggccgaguuggaccugaacaugacccgcucccacucuggaggcgagcuggagagcuuggcucguggaagaaggagccuggguucccugaccauugcugagccggccaugaucgccgagugcaagacgcgcaccgagguguucgagaucucccggcgccucauagaccgcaccaacgccaacuuccugguguggccgcccuguguggaggugcagcgcugcuccggcugcugcaacaaccgcaacgugcagugccgccccacccaggugcagcugcgaccuguccaggugagaaagaucgagauugugcggaagaagccaaucuuuaagaaggccacggugacgcuggaagaccaccuggcaugcaagugugagacaguggcagcugcacggccugugacccgaagcccgggggguucccaggagcagcgagccaaaacgccccaaacucgggugaccauucggacggugcgaguccgccggccccccaagggcaagcaccggaaauucaagcacacgcaugacaagacggcacugaaggagacccuuggagccuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6054 - RNA, 1312 nt, Artificial Sequence
  mRNA product Design1 comprising derived and/or modified sequence from Homo sapiens__NP_149126.1__HsPDGFD (wt)
gggagaaagcuuaccaugcaccggcucaucuuugucuacacucuaaucugcgcaaacuuuugcagcugucgggacacuucugcaaccccgcagagcgcauccaucaaagcauugcgcaacgccaaccucaggcgagaugacuuguaccgaagagaugagaccauccaggugaaaggaaacggcuacgugcagaguccuagauucccgaacagcuaccccaggaaccugcuccugacauggcggcuucacucucaggagaauacacggauacagcuaguguuugacaaucaguuuggauuagaggaagcagaaaaugauaucuguagguaugauuuuguggaaguugaagauauauccgaaaccaguaccauuauuagaggacgaugguguggacacaaggaaguuccuccaaggauaaaaucaagaacgaaccaaauuaaaaucacauucaaguccgaugacuacuuuguggcuaaaccuggauucaagauuuauuauucuuugcuggaagauuuccaacccgcagcagcuucagagaccaacugggaaucugucacaagcucuauuucagggguauccuauaacucuccaucaguaacggaucccacucugauugcggaugcucuggacaaaaaaauugcagaauuugauacaguggaagaucugcucaaguacuucaauccagagucauggcaagaagaucuugagaauauguaucuggacaccccucgguaucgaggcaggucauaccaugaccggaagucaaaaguugaccuggauaggcucaaugaugaugccaagcguuacaguugcacucccaggaauuacucggucaauauaagagaagaacugaaguuggccaauguggucuucuuuccacguugccuccucgugcagcgcuguggaggaaauuguggcuguggaacugucaacuggagguccugcacaugcaauucagggaaaaccgugaaaaaguaucaugagguauuacaguuugagccuggccacaucaagaggagggguagagcuaagaccauggcucuaguugacauccaguuggaucaccaugaacgaugugauuguaucugcagcucaagaccaccucgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6055 - RNA, 895 nt, Artificial Sequence
  mRNA product Design1 comprising derived and/or modified sequence from Homo sapiens__NP_003946.3__HsSOCS3 (wt)
gggagaaagcuuaccauggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagggccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6056 - RNA, 1390 nt, Artificial Sequence
  mRNA product Design1 comprising derived and/or modified sequence from Homo sapiens__NP_000651.3__HsTGFB1 (wt)
gggagaaagcuuaccaugccgcccuccgggcugcggcugcugccgcugcugcuaccgcugcuguggcuacuggugcugacgccuggccggccggccgcgggacuauccaccuguaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacgaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccagaaauacagcaacaauuccuggcgauaccucagcaaccggcugcuggcacccagcgacucgccagagugguuaucuuuugaugucaccggaguugugcggcagugguugagccguggaggggaaauugagggcuuucgccuuagcgcccacugcuccugugacagcagggauaacacacugcaaguggacaucaacggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6057 - RNA, 1462 nt, Artificial Sequence
  mRNA product Design1 comprising derived and/or modified sequence from Homo sapiens__NP_003229.1__HsTGFB2 (wt)
gggagaaagcuuaccaugcacuacugugugcugagcgcuuuucugauccugcaucuggucacggucgcgcucagccugucuaccugcagcacacucgauauggaccaguucaugcgcaagaggaucgaggcgauccgcgggcagauccugagcaagcugaagcucaccagucccccagaagacuauccugagcccgaggaaguccccccggaggugauuuccaucuacaacagcaccagggacuugcuccaggagaaggcgagccggagggcggccgccugcgagcgcgagaggagcgacgaagaguacuacgccaaggagguuuacaaaauagacaugccgcccuucuuccccuccgaaaaugccaucccgcccacuuucuacagacccuacuucagaauuguucgauuugacgucucagcaauggagaagaaugcuuccaauuuggugaaagcagaguucagagucuuucguuugcagaacccaaaagccagagugccugaacaacggauugagcuauaucagauucucaaguccaaagauuuaacaucuccaacccagcgcuacaucgacagcaaaguugugaaaacaagagcagaaggcgaauggcucuccuucgauguaacugaugcuguucaugaauggcuucaccauaaagacaggaaccugggauuuaaaauuagcuuacacugucccugcugcacuuuuguaccaucuaauaauuacaucaucccaaauaaaagugaagaacuagaagcaagauuugcagguauugauggcaccuccacauauaccaguggugaucagaaaacuauaaaguccacuaggaaaaaaaacagugggaagaccccacaucuccugcuaauguuauugcccuccuacagacuugagucacaacagaccaaccggcggaagaagcgugcuuuggaugcggccuauugcuuuagaaaugugcaggauaauugcugccuacguccacuuuacauugauuucaagagggaucuaggguggaaauggauacacgaacccaaaggguacaaugccaacuucugugcuggagcaugcccguauuuauggaguucagacacucagcacagcaggguccugagcuuauauaauaccauaaauccagaagcaucugcuucuccuugcugcgugucccaagauuuagaaccucuaaccauucucuacuacauuggcaaaacacccaagauugaacagcuuucuaauaugauuguaaagucuugcaaaugcagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6058 - RNA, 1456 nt, Artificial Sequence
  mRNA product Design1 comprising derived and/or modified sequence from Homo sapiens__NP_003230.1__HsTGFB3 (wt)
gggagaaagcuuaccaugaagaugcacuugcaaagggcucuggugguccuggcccugcugaacuuugccacggucagccucucucuguccacuugcaccaccuuggacuucggccacaucaagaagaagaggguggaagccauuaggggacagaucuugagcaagcucaggcucaccagccccccugagccaacggugaugacccacguccccuaucagguccuggcccuuuacaacagcacccgggagcugcuggaggagaugcauggggagagggaggaaggcugcacccaggaaaacaccgagucggaauacuaugccaaagaaauccauaaauucgacaugauccaggggcuggcggagcacaacgaacuggcugucugcccuaaaggaauuaccuccaagguuuuccgcuucaauguguccucaguggagaaaaauagaaccaaccuauuccgagcagaguuccgggucuugcgggugcccaaccccagcucuaagcggaaugagcagaggaucgagcuguuccagauccuucggccagaugagcacauugccaaacagcgcuauaucgguggcaagaaucugcccacacggggcacugccgaguggcuguccuuugaugucacugacacugugcgugaguggcuguugagaagagaguccaacuuaggucuagaaaucagcauucacuguccaugucacaccuuucagcccaauggagauauccuggaaaacauucacgaggugauggaaaucaaauucaaaggcguggacaaugaggaugaccauggccguggagaucuggggcgccucaagaagcagaaggaucaccacaacccucaucuaauccucaugaugauucccccacaccggcucgacaacccgggccaggggggucagaggaagaagcgggcuuuggacaccaauuacugcuuccgcaacuuggaggagaacugcugugugcgcccccucuacauugacuuccgacaggaucugggcuggaaguggguccaugaaccuaagggcuacuaugccaacuucugcucaggcccuugcccauaccuccgcagugcagacacaacccacagcacggugcugggacuguacaacacucugaacccugaagcaucugccucgccuugcugcgugccccaggaccuggagccccugaccauccuguacuauguugggaggacccccaaaguggagcagcucuccaacaugguggugaagucuuguaaauguagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6059 - RNA, 1603 nt, Artificial Sequence
  mRNA product Design1 comprising derived and/or modified sequence from Homo sapiens__NP_001057.1__HsTNFRSF1B (wt)
gggagaaagcuuaccauggcgcccgucgccgucugggccgcgcuggccgucggacuggagcucugggcugcggcgcacgccuugcccgcccagguggcauuuacacccuacgccccggagcccgggagcacaugccggcucagagaauacuaugaccagacagcucagaugugcugcagcaaaugcucgccgggccaacaugcaaaagucuucuguaccaagaccucggacaccgugugugacuccugugaggacagcacauacacccagcucuggaacuggguucccgagugcuugagcuguggcucccgcuguagcucugaccagguggaaacucaagccugcacucgggaacagaaccgcaucugcaccuguaggcccggcugguacugcgcgcugagcaagcaggaggggugccggcugugcgcgccgcugcgcaagugccgcccgggcuucggcguggccagaccaggaacugaaacaucagacguggugugcaagcccugugccccggggacguucuccaacacgacuucauccacggauauuugcaggccccaccagaucuguaacgugguggccaucccugggaaugcaagcauggaugcagucugcacguccacgucccccacccggaguauggccccaggggcaguacacuuaccccagccaguguccacacgaucccaacacacgcagccaacuccagaacccagcacugcuccaagcaccuccuuccugcucccaaugggccccagccccccagcugaagggagcacuggcgacuucgcucugccaguuggacugauugugggugugacagccuugggucuacuaauaauaggaguggugaacugugucaucaugacccaggugaaaaagaagcccuugugccugcagagagaagccaaggugccucacuugccugccgauaaggcccgggguacacagggccccgagcagcagcaccuccugaucacagcgccgagcuccagcagcagcucccuggagagcucggccagugcguuggacagaagggcgcccacucggaaccagccacaggcaccaggcguggaggccaguggggccggggaggcccgggccagcaccgggagcucagauucuuccccugguggccaugggacccaggucaaugucaccuguaucgugaacgucuguagcagcucugaccacagcucacagugcuccucccaagccagcuccacaaugggagacacagauuccagccccucggaguccccgaaggacgagcagguccccuucuccaaggaggaaugugccuuucggucacagcuggagacgccagagacccugcuggggagcaccgaagagaagccccugccccuuggagugccugaugcugggaugaagcccaguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6060 - RNA, 1282 nt, Artificial Sequence
  mRNA product Design1 comprising derived and/or modified sequence from Homo sapiens__NP_004460.1__HsVEGFD (wt)
gggagaaagcuuaccauguacagagaguggguaguggugaauguuuucaugauguuguacguccagcuggugcagggcuccaguaaugaacauggaccagugaagcgaucaucucaguccacauuggaacgaucugaacagcagaucagggcugcuucuaguuuggaggaacuacuucgaauuacucacucugaggacuggaagcuguggagaugcaggcugaggcucaaaaguuuuaccaguauggacucucgcucagcaucccaucgguccacuagguuugcggcaacuuucuaugacauugaaacacuaaaaguuauagaugaagaauggcaaagaacucagugcagcccuagagaaacgugcguggagguggccagugagcuggggaagaguaccaacacauucuucaagcccccuugugugaacguguuccgaugugguggcuguugcaaugaagagagccuuaucuguaugaacaccagcaccucguacauuuccaaacagcucuuugagauaucagugccuuugacaucaguaccugaauuagugccuguuaaaguugccaaucauacagguuguaagugcuugccaacagccccccgccauccauacucaauuaucagaagauccauccagaucccugaagaagaucgcuguucccauuccaagaaacucuguccuauugacaugcuaugggauagcaacaaauguaaauguguuuugcaggaggaaaauccacuugcuggaacagaagaccacucucaucuccaggaaccagcucucugugggccacacaugauguuugacgaagaucguugcgagugugucuguaaaacaccaugucccaaagaucuaauccagcaccccaaaaacugcaguugcuuugagugcaaagaaagucuggagaccugcugccagaagcacaagcuauuucacccagacaccuguagcugugaggacagaugccccuuucauaccagaccaugugcaaguggcaaaacagcaugugcaaagcauugccgcuuuccaaaggagaaaagggcugcccaggggccccacagccgaaagaauccuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6061 - RNA, 916 nt, Artificial Sequence
  mRNA product Design2 comprising derived and/or modified sequence from Sus scrofa__P45561-2__SsAMELX-001-2 (wt)
ggggcgcugccuacggagguggcagccaucuccuucucggcaucaagcuuaccauggggaccuggauuuuguuugcuugccuccugggagcagccuucucuaugccucuaccaccucauccugggcacccugguuauaucaacuucagcuauauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6062 - RNA, 952 nt, Artificial Sequence
  mRNA product Design2 comprising derived and/or modified sequence from Sus scrofa__NP_998965.1__SsAMELX-001-3 (wt)
ggggcgcugccuacggagguggcagccaucuccuucucggcaucaagcuuaccauggggaccuggauuuucuuugccugccuuuugggagcaucccuugcuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6063 - RNA, 601 nt, Artificial Sequence
  mRNA product Design2 comprising derived and/or modified sequence from Sus scrofa__K7GPB2__SsAMELX-002 (wt)
ggggcgcugccuacggagguggcagccaucuccuucucggcaucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6064 - RNA, 994 nt, Artificial Sequence
  mRNA product Design2 comprising derived and/or modified sequence from Sus scrofa__K7GLD0__SsAMELX-003 (wt)
ggggcgcugccuacggagguggcagccaucuccuucucggcaucaagcuuaccauggggaccuggauuuuguuugcuugccuccugggagcagccuucucuaugccucuaccaccucauccugggcacccugguuauaucaacuucagcuaugaggacuuauacuuggaggcuauccguauugacaggacugcauucgugcuuaccccucugaagugguaccagaacaugauaagacauccguacacuuccuaugguuacgaacccauggguggauggcugcaccaccaaaucauucccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6065 - RNA, 880 nt, Artificial Sequence
  mRNA product Design2 comprising derived and/or modified sequence from Sus scrofa__K7GPE9__SsAMELX-004 (wt)
ggggcgcugccuacggagguggcagccaucuccuucucggcaucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6066 - RNA, 904 nt, Artificial Sequence
  mRNA product Design2 comprising derived and/or modified sequence from Sus scrofa__J9JIM4__SsAMELX-201 (wt)
ggggcgcugccuacggagguggcagccaucuccuucucggcaucaagcuuaccaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6067 - RNA, 3343 nt, Artificial Sequence
  mRNA product Design2 comprising derived and/or modified sequence from Homo sapiens__NP_006120.1__HsBMP1 (wt)
ggggcgcugccuacggagguggcagccaucuccuucucggcaucaagcuuaccaugcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcggcugccuuucuuggggacauugcccuggacgaagaggaccugagggccuuccagguacagcaggcuguggaucucagacggcacacagcucguaaguccuccaucaaagcugcaguuccaggaaacacuucuacccccagcugccagagcaccaacgggcagccucagaggggagccugugggagauggagagguagaucccguagccggcgggcggcgacgucccgaccagagcguguguggcccgauggggucauccccuuugucauugggggaaacuucacugguagccagagggcagucuuccggcaggccaugaggcacugggagaagcacaccugugucaccuuccuggagcgcacugacgaggacagcuauauuguguucaccuaucgaccuugcgggugcugcuccuacgugggucgccgcggcgggggcccccaggccaucuccaucggcaagaacugugacaaguucggcauugugguccacgagcugggccacgucgucggcuucuggcacgaacacacucggccagaccgggaccgccacguuuccaucguucgugagaacauccagccagggcaggaguauaacuuccugaagauggagccucaggagguggagucccugggggagaccuaugacuucgacagcaucaugcauuacgcucggaacacauucuccaggggcaucuuccuggauaccauuguccccaaguaugaggugaacggggugaaaccucccauuggccaaaggacacggcucagcaagggggacauugcccaagcccgcaagcuguacaagugcccagccuguggagagacccugcaagacagcacaggcaacuucuccuccccugaauaccccaauggcuacucugcucacaugcacugcguguggcgcaucucugucacacccggggagaagaucauccugaacuucacgucccuggaccuguaccgcagccgccugugcugguacgacuauguggagguccgagauggcuucuggaggaaggcgccccuccgaggccgcuucugcggguccaaacucccugagccuaucgucuccacugacagccgccucuggguugaguuccgcagcagcagcaauuggguuggaaagggcuucuuugcagucuacgaagccaucugcgggggugaugugaaaaaggacuauggccacauucaaucgcccaacuacccagacgauuaccggcccagcaaagucugcaucuggcggauccaggugucugagggcuuccacgugggccucacauuccaguccuuugagauugagcgccacgacagcugugccuacgacuaucuggaggugcgcgacgggcacagugagagcagcacccucaucgggcgcuacuguggcuaugagaagccugaugacaucaagagcacguccagccgccucuggcucaaguucgucucugacggguccauuaacaaagcgggcuuugccgucaacuuuuucaaagagguggacgagugcucucggcccaaccgcgggggcugugagcagcggugccucaacacccugggcagcuacaagugcagcugugaccccggguacgagcuggccccagacaagcgccgcugugaggcugcuuguggcggauuccucaccaagcucaacggcuccaucaccagcccgggcuggcccaaggaguacccccccaacaagaacugcaucuggcagcugguggcccccacccaguaccgcaucucccugcaguuugacuucuuugagacagagggcaaugaugugugcaaguacgacuucguggaggugcgcaguggacucacagcugacuccaagcugcauggcaaguucugugguucugagaagcccgaggucaucaccucccaguacaacaacaugcgcguggaguucaaguccgacaacaccguguccaaaaagggcuucaaggcccacuucuucucagacaaggacgagugcuccaaggauaacggcggcugccagcaggacugcgucaacacguucggcaguuaugagugccaaugccgcaguggcuucguccuccaugacaacaagcacgacugcaaagaagccggcugugaccacaaggugacauccaccagugguaccaucaccagccccaacuggccugacaaguaucccagcaagaaggagugcacgugggccaucuccagcacccccgggcaccgggucaagcugaccuucauggagauggacaucgagucccagccugagugugccuacgaccaccuagagguguucgacgggcgagacgccaaggcccccguccucggccgcuucugugggagcaagaagcccgagcccguccuggccacaggcagccgcauguuccugcgcuucuacucagauaacucgguccagcgaaagggcuuccaggccucccacgccacagagugcgggggccagguacgggcagacgugaagaccaaggaccuuuacucccacgcccaguuuggcgacaacaacuacccuggggguguggacugugagugggucauuguggccgaggaaggcuacggcguggagcucguguuccagaccuuugagguggaggaggagaccgacugcggcuaugacuacauggagcuguucgacggcuacgacagcacagcccccaggcuggggcgcuacuguggcucagggccuccugaggagguguacucggcgggagauucuguccuggugaaguuccacucggaugacaccaucaccaaaaaagguuuccaccuccgauacaccagcaccaaguuccaggacacacuccacagcaggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6068 - RNA, 1573 nt, Artificial Sequence
  mRNA product Design2 comprising derived and/or modified sequence from Homo sapiens__NP_001191.1__HsBMP2 (wt)
ggggcgcugccuacggagguggcagccaucuccuucucggcaucaagcuuaccaugguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcagaugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6069 - RNA, 1609 nt, Artificial Sequence
  mRNA product Design2 comprising derived and/or modified sequence from Homo sapiens__NP_001193.2__HsBMP4 (wt)
ggggcgcugccuacggagguggcagccaucuccuucucggcaucaagcuuaccaugauuccugguaaccgaaugcugauggucguuuuauuaugccaaguccugcuaggaggcgcgagccaugcuaguuugauaccugagacggggaagaaaaaagucgccgagauucagggccacgcgggaggacgccgcucagggcagagccaugagcuccugcgggacuucgaggcgacacuucugcagauguuugggcugcgccgccgcccgcagccuagcaagagugccgucauuccggacuacaugcgggaucuuuaccggcuucagucuggggaggaggaggaagaacagauccacagcacuggucuugaguauccugagcgcccggccagccgggccaacaccgugaggagcuuccaccacgaagaacaucuggagaacaucccagggaccagugaaaacucugcuuuucguuuccucuuuaaccucagcagcaucccugagaacgaggugaucuccucugcagagcuucggcuguuccgggagcaggucgaccagggcccugauugggaaaggggcuuccaccguauaaacauuuaugagguuaugaagcccccagcagaaguggugccugggcaccucaucacacgacuacuggacacgagacugguccaccacaaugugacacggugggaaacuuuugaugugagcccugcgguccuucgcuggacccgggagaagcagccaaacuaugggcuagccauugaggugacucaccuccaucagacucggacccaccagggccagcaugucaggauuagccgaucguuaccucaagggagugggaauugggcccagcuccggccccuccuggucaccuuuggccaugauggccggggccaugccuugacccgacgccggagggccaagcguagcccuaagcaucacucacagcgggccaggaagaagaauaagaacugccggcgccacucgcucuauguggacuucagcgaugugggcuggaaugacuggauuguggccccaccaggcuaccaggccuucuacugccauggggacugccccuuuccacuggcugaccaccucaacucaaccaaccaugccauugugcagacccuggucaauucugucaauuccaguauccccaaagccuguugugugcccacugaacugagugccaucuccaugcuguaccuggaugaguaugauaaggugguacugaaaaauuaucaggagaugguaguagagggaugugggugccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6070 - RNA, 1924 nt, Artificial Sequence
  mRNA product Design2 comprising derived and/or modified sequence from Homo sapiens__NP_001709.1__HsBMP6 (wt)
ggggcgcugccuacggagguggcagccaucuccuucucggcaucaagcuuaccaugccggggcuggggcggagggcgcaguggcugugcugguggugggggcugcugugcagcugcugcgggcccccgccgcugcggccgcccuugcccgcugccgcggccgccgccgccggggggcagcugcugggggacggcgggagccccggccgcacggagcagccgccgccgucgccgcaguccuccucgggcuuccuguaccggcggcucaagacgcaggagaagcgggagaugcagaaggagaucuugucggugcuggggcucccgcaccggccccggccccugcacggccuccaacagccgcagcccccggcgcuccggcagcaggaggagcagcagcagcagcagcagcugccucgcggagagcccccucccgggcgacugaaguccgcgccccucuucaugcuggaucuguacaacgcccuguccgccgacaacgacgaggacggggcgucggagggggagaggcagcaguccuggccccacgaagcagccagcucgucccagcgucggcagccgcccccgggcgccgcgcacccgcucaaccgcaagagccuucuggcccccggaucuggcagcggcggcgcguccccacugaccagcgcgcaggacagcgccuuccucaacgacgcggacauggucaugagcuuugugaaccugguggaguacgacaaggaguucuccccucgucagcgacaccacaaagaguucaaguucaacuuaucccagauuccugagggugagguggugacggcugcagaguuccgcaucuacaaggacuguguuauggggaguuuuaaaaaccaaacuuuucuuaucagcauuuaucaagucuuacaggagcaucagcacagagacucugaccuguuuuuguuggacacccguguaguaugggccucagaagaaggcuggcuggaauuugacaucacggccacuagcaaucuguggguugugacuccacagcauaacauggggcuucagcugagcguggugacaagggauggaguccacguccacccccgagccgcaggccuggugggcagagacggcccuuacgacaagcagcccuucaugguggcuuucuucaaagugagugaggugcacgugcgcaccaccaggucagccuccagccggcgccgacaacagagucguaaucgcucuacccagucccaggacguggcgcgggucuccagugcuucagauuacaacagcagugaauugaaaacagccugcaggaagcaugagcuguaugugaguuuccaagaccugggauggcaggacuggaucauugcacccaagggcuaugcugccaauuacugugauggagaaugcuccuucccacucaacgcacacaugaaugcaaccaaccacgcgauugugcagaccuugguucaccuuaugaaccccgaguauguccccaaaccgugcugugcgccaacuaagcuaaaugccaucucgguucuuuacuuugaugacaacuccaaugucauucugaaaaaauacaggaauaugguuguaagagcuuguggaugccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6071 - RNA, 1678 nt, Artificial Sequence
  mRNA product Design2 comprising derived and/or modified sequence from Homo sapiens__NP_001710.1__HsBMP7 (wt)
ggggcgcugccuacggagguggcagccaucuccuucucggcaucaagcuuaccaugcacgugcgcucacugcgagcugcggcgccgcacagcuucguggcgcucugggcaccccuguuccugcugcgcuccgcccuggccgacuucagccuggacaacgaggugcacucgagcuucauccaccggcgccuccgcagccaggagcggcgggagaugcagcgcgagauccucuccauuuugggcuugccccaccgcccgcgcccgcaccuccagggcaagcacaacucggcacccauguucaugcuggaccuguacaacgccauggcgguggaggagggcggcgggcccggcggccagggcuucuccuaccccuacaaggccgucuucaguacccagggccccccucuggccagccugcaagauagccauuuccucaccgacgccgacauggucaugagcuucgucaaccucguggaacaugacaaggaguucuuccacccacgcuaccaccaucgagaguuccgguuugaucuuuccaagaucccagaaggggaagcugucacggcagccgaguuccggaucuacaaggacuacauccgggaacgcuucgacaaugagacguuccggaucagcguuuaucaggugcuccaggagcacuugggcagggaaucggaucucuuccugcucgacagccguacccucugggccucggaggagggcuggcugguguuugacaucacagccaccagcaaccacuggguggucaauccgcggcacaaccugggccugcagcucucgguggagacgcuggaugggcagagcaucaaccccaaguuggcgggccugauugggcggcacgggccccagaacaagcagcccuucaugguggcuuucuucaaggccacggagguccacuuccgcagcauccgguccacggggagcaaacagcgcagccagaaccgcuccaagacgcccaagaaccaggaagcccugcggauggccaacguggcagagaacagcagcagcgaccagaggcaggccuguaagaagcacgagcuguaugucagcuuccgagaccugggcuggcaggacuggaucaucgcgccugaaggcuacgccgccuacuacugugagggggagugugccuucccucugaacuccuacaugaacgccaccaaccacgccaucgugcagacgcugguccacuucaucaacccggaaacggugcccaagcccugcugugcgcccacgcagcucaaugccaucuccguccucuacuucgaugacagcuccaacgucauccugaagaaauacagaaacauggugguccgggccuguggcugccacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6072 - RNA, 682 nt, Artificial Sequence
  mRNA product Design2 comprising derived and/or modified sequence from Homo sapiens__NP_006264.2__HsCCL7 (wt)
ggggcgcugccuacggagguggcagccaucuccuucucggcaucaagcuuaccaugaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6073 - RNA, 4006 nt, Artificial Sequence
  mRNA product Design2 comprising derived and/or modified sequence from Homo sapiens__NP_001954.2__HsEGF (wt)
ggggcgcugccuacggagguggcagccaucuccuucucggcaucaagcuuaccaugcugcucacucuuaucauucuguugccaguaguuucaaaauuuaguuuuguuagucucucagcaccgcagcacuggagcuguccugaagguacucucgcaggaaauggcaauucuacuuguguggguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccugagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcaggaggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcggagcuuucauaugcccuccuaugggacacagacccuugaagggggugucgagaagccccauucucuccuaucagcuaacccauuauggcaacaaagggcccuggacccaccacaccaaauggagcugacucagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6074 - RNA, 892 nt, Artificial Sequence
  mRNA product Design2 comprising derived and/or modified sequence from Homo sapiens__NP_001423.1__HsEREG (wt)
ggggcgcugccuacggagguggcagccaucuccuucucggcaucaagcuuaccaugaccgcggggaggaggauggagaugcucugugccggcagggucccugcgcugcugcucugccuggguuuccaucuucuacaggcaguccucaguacaacugugauuccaucauguaucccaggagaguccagugauaacugcacagcuuuaguucagacagaagacaauccacguguggcucaagugucaauaacaaaguguagcucugacaugaauggcuauuguuugcauggacagugcaucuaucugguggacaugagucaaaacuacugcagaugugaaguggguuauacugguguccgaugugaacacuucuuuuuaaccguccaccaaccuuuaagcaaagaauauguggcuuugaccgugauucuuauuauuuuguuucuuaucacagucgucgguuccacauauuauuucugcagaugguacagaaaucgaaaaaguaaagaaccaaagaaggaauaugagagaguuaccucaggggauccagaguugccgcaagucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6075 - RNA, 1249 nt, Artificial Sequence
  mRNA product Design2 comprising derived and/or modified sequence from Homo sapiens__NP_001997.5__HsFGF2 (wt)
ggggcgcugccuacggagguggcagccaucuccuucucggcaucaagcuuaccauggugggugugggggguggagauguagaagaugugacgccgcggcccggcgggugccagauuagcggacgcggugcccgcgguugcaacgggaucccgggcgcugcagcuugggaggcggcucuccccaggcggcguccgcggagacacccauccgugaaccccaggucccgggccgccggcucgccgcgcaccaggggccggcggacagaagaacggccgagcggcucgaggcugggggaccgcgggcgcggccgcgcgcugccgggcgggaggcuggggggccggggccggggccgugccccggagcgggucggaggccggggccggggccgggggacggcggcuccccgcgcggcuccagcggcucggggaucccggccgggccccgcagggaccauggcagccgggagcaucaccacgcugcccgccuugcccgaggauggcggcagcggcgccuucccgcccggccacuucaaggaccccaagcggcuguacugcaaaaacgggggcuucuuccugcgcauccaccccgacggccgaguugacgggguccgggaaaagagcgacccucacaucaagcuacaacuucaagcagaagagagaggaguugugucuaucaaaggagugugugcuaaccguuaccuggcuaugaaggaagauggaagauuacuggcuucuaaauguguuacggaugaguguuucuuuuuugaacgauuggaaucuaauaacuacaauacuuaccggucaaggaaauacaccaguugguauguggcacugaaacgaacugggcaguauaaacuuggauccaaaacaggaccugggcagaaagcuauacuuuuucuuccaaugucugcuaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6076 - RNA, 967 nt, Artificial Sequence
  mRNA product Design2 comprising derived and/or modified sequence from Homo sapiens__NP_002000.1__HsFGF7 (wt)
ggggcgcugccuacggagguggcagccaucuccuucucggcaucaagcuuaccaugcacaaauggauacugacauggauccugccaacuuugcucuacagaucaugcuuucacauuaucugucuaguggguacuauaucuuuagcuugcaaugacaugacuccagagcaaauggcuacaaaugugaacuguuccagcccugagcgacacacaagaaguuaugauuacauggaaggaggggauauaagagugagaagacucuucugucgaacacagugguaccugaggaucgauaaaagaggcaaaguaaaagggacccaagagaugaagaauaauuacaauaucauggaaaucaggacaguggcaguuggaauuguggcaaucaaagggguggaaagugaguucuaucuugcaaugaacaaggaaggaaaacucuaugcaaagaaagaaugcaaugaagauuguaacuucaaagaacuaauucuggaaaaccauuacaacacauaugcaucagcuaaauggacacacaacggaggggaaauguuuguugccuuaaaucaaaaggggauuccuguaagaggaaaaaaaacgaagaaagaacaaaaaacagcccacuuucuuccuauggcaauaacuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6077 - RNA, 2569 nt, Artificial Sequence
  mRNA product Design2 comprising derived and/or modified sequence from Homo sapiens__NP_000592.3__HsHGF (wt)
ggggcgcugccuacggagguggcagccaucuccuucucggcaucaagcuuaccaugugggugaccaaacuccugccagcccugcugcugcagcauguccuccugcaucuccuccugcuccccaucgccauccccuaugcagagggacaaaggaaaagaagaaauacaauucaugaguucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaaucccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcauggcuuggaauccaugauguccacggaagaggagaugagaaaugcaaacagguucucaauguuucccagcugguauauggcccugaaggaucagaucugguuuuaaugaagcuggccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6078 - RNA, 2308 nt, Artificial Sequence
  mRNA product Design2 comprising derived and/or modified sequence from Homo sapiens__NP_005336.3 __HsHSPA1A (wt)
ggggcgcugccuacggagguggcagccaucuccuucucggcaucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggucagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaaaagcgccguggaggaugaggggcucaagggcaagaucagcgaggcggacaagaagaaggugcuggacaagugucaagaggucaucucguggcuggacgccaacaccuuggccgagaaggacgaguuugagcacaagaggaaggagcuggagcaggucuguaaccccaucaucagcggacuguaccagggugccgguggucccgggccugggggcuucggggcucagggucccaagggagggucugggucaggccccaccauugaggagguagauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6079 - RNA, 2308 nt, Artificial Sequence
  mRNA product Design2 comprising derived and/or modified sequence from Homo sapiens__NP_005337.2 __HsHSPA1B (wt)
ggggcgcugccuacggagguggcagccaucuccuucucggcaucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggucagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaaaagcgccguggaggaugaggggcucaagggcaagaucagcgaggcggacaagaagaagguucuggacaagugucaagaggucaucucguggcuggacgccaacaccuuggccgagaaggacgaguuugagcacaagaggaaggagcuggagcaggucuguaaccccaucaucagcggacuguaccagggugccgguggucccgggccuggcggcuucggggcucagggucccaagggagggucugggucaggcccuaccauugaggagguggauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6080 - RNA, 2308 nt, Artificial Sequence
  mRNA product Design2 comprising derived and/or modified sequence from Homo sapiens__NP_005518.3 __HsHSPA1L (wt)
ggggcgcugccuacggagguggcagccaucuccuucucggcaucaagcuuaccauggcuacugccaagggaaucgccauaggcaucgaccugggcaccaccuacuccuguguggggguguuccagcacggcaagguggagaucaucgccaacgaccagggcaaccgcaccacccccagcuacguggccuucacagacaccgagcggcucauuggggaugcggccaagaaccagguagcaaugaauccccagaacacuguuuuugaugcuaaacgucugaucggcaggaaauuuaaugauccuguuguacaagcagauaugaaacuuuggccuuuucaagugauuaaugaaggaggcaagcccaaaguccuuguguccuacaaaggggagaauaaagcauucuacccugaggaaaucucuucgaugguauugacuaaguugaaggagacugcugaggccuuuuugggccacccugucaccaaugcagugauuaccgugccagccuauuucaaugacucucaacgucaggcuacuaaggaugcaggagugauugcuggacuuaaugugcuaagaaucaucaaugagcccacggcugcugccauugccuaugguuuagauaaaggaggucaaggagaacgacauguccugauuuuugaucuggguggaggcacauuugaugugucaauucugaccauagaugaugggauuuuugagguaaaggccacugcuggggacacucaccuggguggggaggacuuugacaacaggcuugugagccacuucguggaggaguucaagaggaaacacaaaaaggacaucagccagaacaagcgagccgugaggcggcugcgcaccgccugcgagagggccaagaggacccugucguccagcacccaggccaaccuagaaauugauucacuuuaugaaggcauugacuucuauacauccaucaccagagcucgauuugaagaguugugugcagaccuguuuagggguacccuggagccuguagaaaaagcgcuucgggaugccaagauggauaaggcuaaaauccaugacauuguuuuaguagggggcuccacccgcauccccaaggugcagcggcugcuucaggacuacuucaauggacgugaucucaacaagagcaucaacccugaugaggccguagcauauggggcugcgguacaagcagccauccugaugggggacaagucugagaagguacaggaccugcugcugcuggacguggcuccccugucccuggggcuggagacggcugggggcgugaugacugcccugauaaagcgcaacuccaccauccccaccaagcagacacagauuuucaccaccuacucugacaaccaacccggggugcugauccagguguaugagggcgagagggccaugacaaaggacaacaaccugcuggggcgguuugaccugacuggaaucccuccagcacccaggggaguuccucagaucgaggugacguuugacauugaugccaaugguauucucaaugucacagccacggacaagagcaccggcaaggugaacaagaucaccaucaccaaugacaagggccgccugagcaaggaggagauugagcgcaugguucuggaugcugagaaauauaaagcugaagaugagguccagagggagaaaauugcugcaaagaaugccuuagaauccuaugcuuuuaacaugaagaguguugugagugaugaagguuugaagggcaagauuagugagucugauaaaaauaaaauauuggauaaaugcaacgagcuccuuucguggcuggaggucaaucaacuggcagagaaagaugaguuugaucauaagagaaaggaauuggagcagauguguaacccuaucaucacaaaacucuaccaaggaggaugcacugggccugccugcggaacaggguaugugccuggaaggccugccacaggccccacaauugaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6081 - RNA, 2905 nt, Artificial Sequence
  mRNA product Design2 comprising derived and/or modified sequence from Homo sapiens__NP_002145.3 __HsHSPA4 (wt)
ggggcgcugccuacggagguggcagccaucuccuucucggcaucaagcuuaccaugucgguggugggcauagaccugggcuuccagagcugcuacgucgcuguggcccgcgccggcggcaucgagacuaucgcuaaugaguauagcgaccgcugcacgccggcuugcauuucuuuugguccuaagaaucguucaauuggagcagcagcuaaaagccagguaauuucuaaugcaaagaacacaguccaaggauuuaaaagauuccauggccgagcauucucugauccauuuguggaggcagaaaaaucuaaccuugcauaugauauugugcaguugccuacaggauuaacagguauaaaggugacauauauggaggaagaacgaaauuuuaccacugagcaagugacugccaugcuuuuguccaaacugaaggagacagccgaaaguguucuuaagaagccuguaguugacuguguuguuucgguuccuuguuucuauacugaugcagaaagacgaucagugauggaugcaacacagauugcuggucuuaauugcuugcgauuaaugaaugaaaccacugcaguugcucuugcauauggaaucuauaagcaggaucuuccugccuuagaagagaaaccaagaaauguaguuuuuguagacaugggccacucugcuuaucaaguuucuguaugugcauuuaauagaggaaaacugaaaguucuggccacugcauuugacacgacauugggagguagaaaauuugaugaaguguuaguaaaucacuucugugaagaauuugggaagaaauacaagcuagacauuaaguccaaaauccgugcauuauuacgacucucucaggagugugagaaacucaagaaauugaugagugcaaaugcuucagaucucccuuugagcauugaauguuuuaugaaugauguugauguaucuggaacuaugaauagaggcaaauuucuggagaugugcaaugaucucuuagcuagaguggagccaccacuucguaguguuuuggaacaaaccaaguuaaagaaagaagauauuuaugcaguggagauaguugguggugcuacacgaaucccugcgguaaaagagaagaucagcaaauuuuucgguaaagaacuuaguacaacauuaaaugcugaugaagcugucacucgaggcugugcauugcagugugccaucuuaucgccugcuuucaaagucagagaauuuucuaucacugauguaguaccauauccaauaucucugagauggaacucuccagcugaagaagggucaagugacugugaagucuuuuccaaaaaucaugcugcuccuuucucuaaaguucuuacauuuuauagaaaggaaccuuucacucuugaggccuacuacagcucuccucaggauuugcccuauccagauccugcuauagcucaguuuucaguucagaaagucacuccucagucugauggcuccaguucaaaagugaaagucaaaguucgaguaaauguccauggcauuuucaguguguccagugcaucuuuaguggagguucacaagucugaggaaaaugaggagccaauggaaacagaucagaaugcaaaggaggaagagaagaugcaaguggaccaggaggaaccacauguugaagaacaacagcagcagacaccagcagaaaauaaggcagagucugaagaaauggagaccucucaagcuggauccaaggauaaaaagauggaccaaccaccccaagccaagaaggcaaaagugaagaccaguacuguggaccugccaaucgagaaucagcuauuauggcagauagacagagagaugcucaacuuguacauugaaaaugaggguaagaugaucaugcaggauaaacuggagaaggagcggaaugaugcuaagaacgcaguggaggaauauguguaugaaaugagagacaagcugaguggugaauaugagaaguuugugagugaagaugaucguaacaguuuuacuuugaaacuggaagauacugaaaauugguuguaugaggauggagaagaccagccaaagcaaguuuauguugauaaguuggcugaauuaaaaaaucuaggucaaccuauuaagauacguuuccaggaaucugaagaacgaccaaaauuauuugaagaacuagggaaacagauccaacaguauaugaaaauaaucagcucuuucaaaaacaaggaggaccaguaugaucauuuggaugcugcugacaugacaaagguagaaaaaagcacaaaugaagcaauggaguggaugaauaacaagcuaaaucugcagaacaagcagaguuugaccauggauccaguugucaagucaaaagagauugaagcuaaaauuaaggagcugacaaguacuuguagcccuauaauuucaaagcccaaacccaaaguggaaccuccaaaagaggaacaaaaaaaugcagagcagaauggaccaguggauggacaaggagacaacccaggcccccaggcugcugagcaggguacagacacagcugugccuucggauucagacaagaagcugccugaaauggacauugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6082 - RNA, 2902 nt, Artificial Sequence
  mRNA product Design2 comprising derived and/or modified sequence from Homo sapiens__NP_055093.2 __HsHSPA4L (wt)
ggggcgcugccuacggagguggcagccaucuccuucucggcaucaagcuuaccaugucugugguuggcauugaccucggcuuucucaacugcuacauugcugucgcgagaaguggcggcaucgagaccaucgccaaugaguacagcgacagguguaccccggccuguauaucauugggaucaagaacucgagccauuggaaaugcagcaaagagccagauagucacgaacguaagaaauacaauucauggcuucaaaaagcugcaugggcgaucauuugaugaucccauugugcaaacugaaaggaucaggcuucccuaugaacugcagaaaaugccuaauggaagugcaggaguuaaggugcgguacuuagaggaagagagaccuuuugcaauugagcaaguuacuggaaugcuguuagccaagcugaaagagacuucagaaaaugcuuugaagaaaccaguggcugacugugugauuucaauuccuagcuuuuuuacugaugccgagagaagaucugugauggcugcagcccagguugcaggcuuaaauuguuuaagguugaugaaugaaacuacugcaguugcacuggcguauggaauuuauaaacaggaucuucccccauuagaugagaaaccaagaaauguaguauuuauugauaugggacauucugccuaucaggucuugguuugugcuuuuaacaaaggaaaacuuaaagucuuggcuacuaccuuugauccauauuuggguggcaggaacuuugaugaggcuuuaguagacuacuucugugaugaguucaagaccaaauauaagauaaaugugaaagaaaacucucgggccuuguugcguuuauaucaggaaugugaaaaacuaaagaagcuaaugagugcaaaugcaucagaucuuccauugaacauugaguguuucaugaaugaccuugauguuucuaguaaaaugaacagggcucaauuugaacaacugugugcuucccuuuuggccaggguugaaccaccuuuaaaagcaguaauggaacaagcuaacuuacaacgugaagacauuaguaguauagaaauuguaggaggagcaacacgaaucccugcagugaaagaacaaaucacuaaauucuuucuuaaagacauaaguaccacauuaaaugcugaugaagcuguugcaagaggaugugcguuacagugugcgauucucucaccagcauuuaaagugcgugaauuuuccauaacagaccuuguucccuauucaaucacauuaagguggaagaccucuuuugaagauggaaguggggaaugugaaguuuucuguaagaaccauccugccccauucucaaaagucauuacuuuccacaagaaggaaccauuugaacuagaagcauuuuauacuaauuuacaugaagugccuuauccugaugcaagaauugggagcuucacuauucagaauguuuuuccacagucugauggugauaguuccaaagugaagguuaaaguucguguuaacauccauggaaucuucaguguggcuagcgcaucaguaauugagaagcaaaauuuggaaggcgaucacagugaugcuccaauggagacagaaacuucauuuaaaaaugaaaacaaagauaauauggauaaaaugcagguugaucaagaagaagggcaucaaaaaugucaugcugaacacacuccagaagaggaaauugaucauacaggagccaaaacaaagucagcugucucagacaaacaagaccgauuaaaucagacacuuaaaaaaggaaaagucaaaaguauugaucuaccgauccagaguagccuauguagacaacuaggccaagaucuucucaacagcuacauugaaaaugaggggaagaugaucaugcaagauaaguuagagaaagaaagaaaugaugcuaagaaugccguugaagaauauguauaugauuuuagagacaggcugggcacugucuaugaaaaauucaucacuccagaagacuugaguaaacugucugcaguauuggaagacacagaaaauuggcuuuaugaagacggagaggaccaaccuaaacaaguuuauguggauaagcugcaagaacuaaagaaauacggccagccuauucaaaugaaguacauggagcaugaagagagaccaaaagccuuaaaugacuugggaaaaaagauccaacuugucaugaaagugauagaagcauauagaaacaaggaugaaagauaugaucaucuggauccuacugaaauggaaaagguugaaaaauguaucagugaugccaugaguuggcugaauaguaagaugaaugcacagaacaaacuaagucucacucaagauccugugguaaaaguuucagaaauaguagcaaagucaaaggaacuggauaauuucuguaaccccaucauuuacaagcccaaaccaaaagcagaaguuccugaagacaaaccaaaagcuaauagugaacacaauggcccaauggauggacagaguggaacugaaacuaaaucagauucaacaaaagacagcucacagcauacuaaauccucuggagagauggaaguggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6083 - RNA, 2347 nt, Artificial Sequence
  mRNA product Design2 comprising derived and/or modified sequence from Homo sapiens__NP_005338.1__HsHSPA5 (wt)
ggggcgcugccuacggagguggcagccaucuccuucucggcaucaagcuuaccaugaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagaacucaacauggaucuguuccggucuacuaugaagcccguccagaaaguguuggaagauucugauuugaagaagucugauauugaugaaauuguucuuguugguggcucgacucgaaucccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaaucccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6084 - RNA, 2314 nt, Artificial Sequence
  mRNA product Design2 comprising derived and/or modified sequence from Homo sapiens__NP_002146.2__HsHSPA6 (wt)
ggggcgcugccuacggagguggcagccaucuccuucucggcaucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccggguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccgccuauuucaaugacucgcagcgccaggccaccaaggacgcgggggccaucgcggggcucaacguguugcggaucaucaaugagcccacggcagcugccaucgccuaugggcuggaccggcggggcgcgggagagcgcaacgugcucauuuuugaccugggugggggcaccuucgaugugucgguucucuccauugacgcuggugucuuugaggugaaagccacugcuggagauacccaccugggaggagaggacuucgacaaccggcucgugaaccacuucauggaagaguuccggcggaagcaugggaaggaccugagcgggaacaagcgugcccugcgcaggcugcgcacagccugugagcgcgccaagcgcacccuguccuccagcacccaggccacccuggagauagacucccuguucgagggcguggacuucuacacguccaucacucgugcccgcuuugaggaacugugcucagaccucuuccgcagcacccuggagccgguggagaaggcccugcgggaugccaagcuggacaaggcccagauucaugacgucguccugguggggggcuccacacgcauccccaaggugcagaaguugcugcaggacuucuucaacggcaaggagcugaacaagagcaucaacccugaugaggcuguggccuauggggcugcugugcaggcggccguguugaugggggacaaaugugagaaagugcaggaucuccugcugcuggauguggcuccccugucucuggggcuggagacagcaggaggggugaugaccacgcugauccagaggaacgccacuauccccaccaagcagacccagacuuucaccaccuacucggacaaccagccuggggucuucauccagguguaugagggugagagggccaugaccaaggacaacaaccugcuggggcguuuugaacucaguggcaucccuccugccccacguggagucccccagauagaggugacuuuugacauugaugcuaauggcauccugagcgugacagccacugacaggagcacagguaaggcuaacaagaucaccaucaccaaugacaagggccggcugagcaaggaggagguggagaggaugguucaugaagccgagcaguacaaggcugaggaugaggcccagagggacagaguggcugccaaaaacucgcuggaggcccaugucuuccaugugaaagguucuuugcaagaggaaagccuuagggacaagauucccgaagaggacaggcgcaaaaugcaagacaagugucgggaaguccuugccuggcuggagcacaaccagcuggcagagaaggaggaguaugagcaucagaagagggagcuggagcaaaucugucgccccaucuucuccaggcucuauggggggccuggugucccugggggcagcaguuguggcacucaagcccgccagggggaccccagcaccggccccaucauugaggagguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6085 - RNA, 1486 nt, Artificial Sequence
  mRNA product Design2 comprising derived and/or modified sequence from Homo sapiens__P48741__HsHSPA7 (wt)
ggggcgcugccuacggagguggcagccaucuccuucucggcaucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccagguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccaccuauuucaguaacucgcagcgccaggccaccaaggacgcgggggccaucgcggggcucaaggugcugccgaucaucaaugaggccacggcagcagccaucgccuaugggcuggaccggcggggcgcgggaaagcgcaacgugcucauuuuugaccugggugggggcaccuucgaugugucgguucucuccauugacgccggugucuuugaggugaaagccacugcuggagauacccaccugggaggagaggacuucgacaaccggcucgugaaccacuucauggaagaguuccggcggaagcaugggaaggaccugagcgggaacaagcgugcccugcgcaggcugcgcacagccugugagcgcgccaagcgcaccccguccuccagcacccaggccacccuggagauagacucccuguucgagggcguggacuucuacaaguccaucacucgugcccgcuuugaggaacugugcucagaccucuuccgcagcacccuggagccgguggagaaggcccugcgggaugccaagcuggacaaggcccagauucaugacuucguccuggggggagggcuccacucgcauccccaaggugcagaaguugcugcaggacuucuucaacggcaaggagcugaacaagagcaucaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6086 - RNA, 2323 nt, Artificial Sequence
  mRNA product Design2 comprising derived and/or modified sequence from Homo sapiens__NP_006588.1 __HsHSPA8 (wt)
ggggcgcugccuacggagguggcagccaucuccuucucggcaucaagcuuaccauguccaagggaccugcaguugguauugaucuuggcaccaccuacucuuguguggguguuuuccagcacggaaaagucgagauaauugccaaugaucagggaaaccgaaccacuccaagcuaugucgccuuuacggacacugaacgguugaucggugaugccgcaaagaaucaaguugcaaugaaccccaccaacacaguuuuugaugccaaacgucugauuggacgcagauuugaugaugcuguuguccagucugauaugaaacauuggcccuuuaugguggugaaugaugcuggcaggcccaagguccaaguagaauacaagggagagaccaagagcuucuauccagaggaggugucuucuaugguucugacaaagaugaaggaaauugcagaagccuaccuugggaagacuguuaccaaugcuguggucacagugccagcuuacuuuaaugacucucagcgucaggcuaccaaagaugcuggaacuauugcuggucucaauguacuuagaauuauuaaugagccaacugcugcugcuauugcuuacggcuuagacaaaaagguuggagcagaaagaaacgugcucaucuuugaccugggagguggcacuuuugaugugucaauccucacuauugaggauggaaucuuugaggucaagucuacagcuggagacacccacuuggguggagaagauuuugacaaccgaauggucaaccauuuuauugcugaguuuaagcgcaagcauaagaaggacaucagugagaacaagagagcuguaagacgccuccguacugcuugugaacgugcuaagcguacccucucuuccagcacccaggccaguauugagaucgauucucucuaugaaggaaucgacuucuauaccuccauuacccgugcccgauuugaagaacugaaugcugaccuguuccguggcacccuggacccaguagagaaagcccuucgagaugccaaacuagacaagucacagauucaugauauuguccugguuggugguucuacucguauccccaagauucagaagcugcuccaagacuucuucaauggaaaagaacugaauaagagcaucaacccugaugaagcuguugcuuauggugcagcuguccaggcagccaucuugucuggagacaagucugagaauguucaagauuugcugcucuuggaugucacuccucuuucccuugguauugaaacugcugguggagucaugacuguccucaucaagcguaauaccaccauuccuaccaagcagacacagaccuucacuaccuauucugacaaccagccuggugugcuuauucagguuuaugaaggcgagcgugccaugacaaaggauaacaaccugcuuggcaaguuugaacucacaggcauaccuccugcaccccgagguguuccucagauugaagucacuuuugacauugaugccaaugguauacucaaugucucugcuguggacaagaguacgggaaaagagaacaagauuacuaucacuaaugacaagggccguuugagcaaggaagacauugaacguaugguccaggaagcugagaaguacaaagcugaagaugagaagcagagggacaaggugucauccaagaacucacuugaguccuaugccuucaacaugaaagcaacuguugaagaugagaaacuucaaggcaagauuaacgaugaggacaaacagaagauucuggacaaguguaaugaaauuaucaacuggcuugauaagaaucagacugcugagaaggaagaauuugaacaucaacagaaagagcuggagaaaguuugcaaccccaucaucaccaagcuguaccagagugcaggaggcaugccaggaggaaugccugggggauuuccuggugguggagcuccucccucugguggugcuuccucagggcccaccauugaagagguugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6087 - RNA, 2422 nt, Artificial Sequence
  mRNA product Design2 comprising derived and/or modified sequence from Homo sapiens__NP_004125.3 __HsHSPA9 (wt)
ggggcgcugccuacggagguggcagccaucuccuucucggcaucaagcuuaccaugauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaaaagccagguauucucuacugccgcugauggucaaacgcaaguggaaauuaaagugugucagggugaaagagagauggcuggagacaacaaacuccuuggacaguuuacuuugauuggaaucccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaguucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucacugaagcuguucgaaauggcauacaaaaagauggcaucugagcgagaaggcucuggaaguucuggcacuggggaacaaaaggaagaucaaaaggaggaaaaacaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6088 - RNA, 2443 nt, Artificial Sequence
  mRNA product Design2 comprising derived and/or modified sequence from Homo sapiens__NP_443202.3 __HsHSPA12B (wt)
ggggcgcugccuacggagguggcagccaucuccuucucggcaucaagcuuaccauguuggcugucccggagaugggccugcaggggcuguacaucggcuccagcccggagcgguccccagugccuagcccacccggcuccccgaggacccaggaaagcugcggcauugccccccucacacccucgcagucuccaaaacccgagguccgagccccccagcaggccuccuucucuguggugguggccauugacuucggcaccacgucuaguggcuaugcuuucagcuuugccagugacccugaggccauccacaugaugaggaaaugggagggcggagacccgggcguggcccaccagaagaccccgaccugccugcugcugacuccggagggcgccuuccacagcuuuggcuacaccgcccgcgauuacuaccaugaccuggaccccgaagaggcgcgggacuggcucuacuucgagaaguucaagaugaagauccacagcgccacggaucucaccuugaagacccagcuagaggcaguaaauggaaagacgaugcccgcccuggagguguucgcccaugcccugcgcuucuucagggagcacgcccuucaggagcugagggagcagagcccaucgcugccagagaaggacacugugcgcuggguguugacggugccugccaucuggaaacagccagccaagcaguucaugcgggaggcugccuaccuggcuggacuugugucccgagagaaugcagagcagcuacucaucgcccuggagcccgaggccgccucgguauacugccgcaagcugcgccugcaccagcuccuggaccugaguggccgggccccagguggugggcgccugggugagcgccgcuccaucgacuccagcuuccgucaggcucgggagcagcugcgaaggucccgccacagccgcacguuccugguggagucaggcguaggagagcugugggcagagaugcaagcaggagaccgcuacgugguggccgacugcggcggaggcaccguggaccugacggugcaccagcuggagcagccccauggcacccucaaggagcucuacaaggcaucugggggcccuuauggcgcggugggcguggaccuggccuucgagcagcugcugugccgcaucuucggcgaggacuucaucgccaccuucaaaaggcaacggccggcagccuggguagaucugaccaucgccuucgaggcucgcaagcgcacugcuggcccacaccgugcaggggcgcucaacaucucgcugcccuucuccuucauugacuucuaccgcaagcagcggggccacaacguggagaccgcucugcgcaggagcagcgugaacuucgugaagugguccucacaggggaugcuccgaaugucuugugaagccaugaacgagcucuuucagcccaccgucagcgggaucauccagcacauagaggcccugcuggcacggccggaggugcagggugugaagcugcuguuccuagugggcggcuucgccgagucagcggugcugcagcacgcggugcaggcggcgcugggcgcccgcggucugcgugucguggucccgcacgacgugggccucaccauccucaaaggcgcggugcuguucggccaggcgccgggcguggugcggguccgccgcucgccgcucaccuauggcgugggcgugcucaaccgcuuugugccugggcgccacccgcccgaaaagcugcugguucgcgacggccgccgcuggugcaccgacgucuucgagcgcuucguggccgccgagcagucgguggcccugggcgaggaggugcggcgcagcuacugcccggcgcgucccggccagcggcgcguacucaucaaccuguacugcugcgcggcagaggaugcgcgcuucaucaccgaccccggcgugcgcaaaugcggcgcgcucagccucgagcuugagcccgccgacugcggccaggacaccgccggcgcgccucccggccgccgcgagauccgcgccgccaugcaguuuggcgacaccgaaauuaaggucaccgccgucgacgucagcaccaaucgcuccgugcgcgcguccaucgacuuucuuuccaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6089 - RNA, 1912 nt, Artificial Sequence
  mRNA product Design2 comprising derived and/or modified sequence from Homo sapiens__NP_057383.2__HsHSPA14 (wt)
ggggcgcugccuacggagguggcagccaucuccuucucggcaucaagcuuaccauggcggccaucggaguucaccugggcugcaccucagccuguguggccgucuauaaggauggccgggcuggugugguugcaaaugaugccggugaccgaguuacuccagcuguuguugcuuacucagaaaaugaagagauuguuggauuggcagcaaaacaaaguagaauaagaaauauuucaaauacaguaaugaaaguaaagcagauccugggcagaagcuccagugauccacaagcucagaaauacaucgcggaaaguaaauguuuagucauugaaaaaaaugggaaauuacgauaugaaauagauacuggagaagaaacaaaauuuguuaacccagaagauguugccagacugauauuuaguaaaaugaaagaaacggcacauucuguauugggcucagaugcaaaugauguaguuauuacugucccguuugauuuuggagaaaagcaaaaaaaugcucuuggagaagcagcuagagcugcuggauuuaauguuuugcgauuaauucacgaaccgucugcagcucugcuugcuuauggaauuggacaagacuccccuacuggaaaaagcaauauuuugguguuuaagcugggaggaacauccuuaucucucagcgucauggaaguuaacaguggaauauaucggguucuuucaacaaacacugaugauaacaucgguggugcacauuucacagaaaccuuagcacaguaucuagcuucugaguuccaaagauccuucaaacaugaugugagaggaaaugcgcgagccaugaugaaauuaacgaacagugcugaaguagcgaaacauucuuugucaaccuugggaagugccaacuguuuucuugacucauuauaugaaggucaagauuuugauugcaauguguccagagcaagauuugaacuucuuuguucuccacuuuuuaauaaguguauagaagcaaucagaggacucuuagaucaaaauggauuuacagcagaugauaucaacaagguuguccuuuguggagggucuucucgaaucccaaagcuacagcaacugauuaaagaucuuuucccagcuguugagcuucucaauucuaucccuccugaugaagugaucccuauuggugcagcuauagaagcaggaauccuuauugggaaagaaaaccuguugguggaagacucucuuaugauagaguguucagccagagauauuuuaguuaaggguguggacgaaucaggagccaguagauucacagugcuguuuccaucagggacuccuuugccagcucgaagacaacacacauugcaagccccuggaagcauaucuucagugugccuugaacucuaugagucugaugggaagaacucugccaaagaggaaaccaaguuugcacagguuguacuccaggauuuagauaaaaaagaaaauggauuacgugauauauuagcuguucuuacuaugaaaagggauggaucuuuacaugugacaugcacagaucaagaaacuggaaaaugugaagcaaucucuauugagauagcaucuuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6090 - RNA, 2959 nt, Artificial Sequence
  mRNA product Design2 comprising derived and/or modified sequence from Homo sapiens__NP_006635.2 __HsHSPH1 (wt)
ggggcgcugccuacggagguggcagccaucuccuucucggcaucaagcuuaccaugucgguggugggguuggacgugggcucgcagagcugcuacaucgcgguagcccgggccgggggcaucgagaccaucgccaaugaguucagcgaccggugcaccccgucagucauaucauuuggaucaaaaaauagaacaaucggaguugcagccaaaaaucagcaaaucacucaugcaaacaauacggugucuaacuucaaaagauuucauggccgagcauucaaugaccccuucauucaaaaggagaaggaaaacuugaguuacgauuugguuccauugaaaaaugguggaguuggaauaaagguaauguacaugggugaagaacaucuauuuaguguggagcagauaacagccauguuguugacuaagcugaaggaaacugcugaaaacagccucaagaaaccaguaacagauuguguuauuucaguccccuccuucuuuacagaugcugagaggcgaucuguguuagaugcugcacagauuguuggccuaaacuguuuaagacuuaugaaugacaugacagcuguugcuuugaauuacggaauuuauaagcaggaucucccaagccuggaugagaaaccucggauagugguuuuuguugauaugggacauucagcuuuucaagugucugcuugugcuuuuaacaagggaaaauugaagguacugggaacagcuuuugauccuuucuuaggaggaaaaaacuucgaugaaaaguuaguggaacauuuuugugcagaauuuaaaacuaaguacaaguuggaugcaaaauccaaaauacgagcacuccuacgucuguaucaggaaugugaaaaacugaaaaagcuaaugagcucuaacagcacagaccuuccacugaauaucgaaugcuuuaugaaugauaaagauguuuccggaaagaugaacaggucacaauuugaagaacucugugcugaacuucugcaaaagauagaaguaccccuuuauucacuguuggaacaaacucaucucaaaguagaagaugugagugcaguugagauuguuggaggcgcuacacgaaucccagcugugaaggaaagaauugccaaauucuuuggaaaagauauuagcacaacacucaaugcagaugaagcaguagccagaggaugugcauuacagugugcaauacuuuccccggcauuuaaaguuagagaauuuuccgucacagaugcaguuccuuuuccaauaucucugaucuggaaccaugauucagaagauacugaagguguucaugaagucuuuagucgaaaccaugcugcuccuuucuccaaaguucucaccuuucugagaagggggccuuuugagcuagaagcauucuauucugauccccaaggaguuccauauccagaagcaaaaauaggccgcuuuguaguucagaauguuucugcacagaaagauggagaaaaaucuagaguaaaagucaaagugcgagucaacacccauggcauuuucaccaucucuacggcaucuaugguggagaaagucccaacugaggagaaugaaaugucuucugaagcugacauggagugucugaaucagagaccaccagaaaacccagacacugauaaaaauguccagcaagacaacagugaagcuggaacacagccccagguacaaacugaugcucaacaaaccucacagucucccccuucaccugaacuuaccucagaagaaaacaaaaucccagaugcugacaaagcaaaugaaaaaaaaguugaccagccuccagaagcuaaaaagcccaaaauaaagguggugaauguugagcugccuauugaagccaacuuggucuggcaguuagggaaagaccuucuuaacauguauauugagacagaggguaagaugauaaugcaagauaaauuggaaaaagaaaggaaugaugcuaaaaaugcaguugaggaauauguguaugaguucagagacaagcuguguggaccauaugaaaaauuuauaugugagcaggaucaucaaaauuuuuugagacuccucacagaaacugaagacuggcuguaugaagaaggagaggaccaagcuaaacaagcauauguugacaaguuggaagaauuaaugaaaauuggcacuccaguuaaaguucgguuucaggaagcugaagaacggccaaaaauguuugaagaacuaggacagaggcugcagcauuaugccaagauagcagcugacuucagaaauaaggaugagaaauacaaccauauugaugagucugaaaugaaaaaaguggagaagucuguuaaugaagugauggaauggaugaauaaugucaugaaugcucaggcuaaaaagagucuugaucaggauccaguuguacgugcucaggaaauuaaaacaaaaaucaaggaauugaacaacacaugugaacccguuguaacacaaccgaaaccaaaaauugaaucacccaaacuggaaagaacuccaaauggcccaaauauugauaaaaaggaagaagauuuagaagacaaaaacaauuuuggugcugaaccuccacaucagaauggugaauguuacccuaaugagaaaaauucuguuaauauggacuuggacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6091 - RNA, 3382 nt, Artificial Sequence
  mRNA product Design2 comprising derived and/or modified sequence from Homo sapiens__NP_006380.1 __HsHYOU1 (wt)
ggggcgcugccuacggagguggcagccaucuccuucucggcaucaagcuuaccauggcagacaaaguuaggaggcagaggccgaggaggcgagucuguugggccuugguggcugugcucuuggcagaccuguuggcacugagugauacacuggcagugaugucuguggaccugggcagugaguccaugaagguggccauugucaaaccuggagugcccauggaaauugucuugaauaaggaaucucggaggaaaacaccggugaucgugacccugaaagaaaaugaaagauucuuuggagacagugcagcaagcauggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgcagcugcaguucucaccugaggaaguguugggcaugguucucaauuauucucguucucuagcugaagauuuugcagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccagaauaucauguucuaugacaugggcucaggcagcaccguaugcaccauugugaccuaccagauggugaagacuaaggaagcugggaugcagccacagcugcagauccggggaguaggauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacagauugaaggccugauggaugauguggacuucaaggcaaaagugacucguguggaauuugaggaguugugugcagacuuguuugagcgggugccugggccuguacagcaggcccuccagagugccgaaaugagucuggaugagauugagcaggucauccugguggguggggccacucggguccccagaguucaggaggugcugcugaaggccgugggcaaggaggagcuggggaagaacaucaaugcagaugaagcagccgccaugggggcaguguaccaggcagcugcgcucagcaaagccuuuaaagugaagccauuugucguccgagaugcaguggucuaccccauccugguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggguauuuggcucccagaaucugaccacagugaagcuaaaaggggugggugacagcuucaagaaguauccugacuacgaguccaagggcaucaaggcucacuucaaccuggaugagaguggcgugcucagucuagacaggguggagucuguauuugagacacugguagaggacagcgcagaagaggaaucuacucucaccaaacuuggcaacaccauuuccagccuguuuggaggcgguaccacaccagaugccaaggagaaugguacugauacuguccaggaggaagaggagagcccugcagaggggagcaaggacgagccuggggagcaggucgagcucaaggaggaagcugaggccccaguggaggauggcucucagcccccacccccugaaccuaagggagaugcaaccccugagggagaaaaggccacagaaaaagaaaauggggacaagucugaggcccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaacuucaggacuugacacuccgagaccuggagaagcaggaacgggaaaaagcugccaacagcuuggaagcauucauauuugagacccaggacaagcuguaccagcccgaguaccaggaaguguccacagaggagcagcgugaggagaucucugggaagcucagcgccgcauccaccuggcuggaggaugaggguguuggagccaccacagugauguugaaggagaagcuggcugagcugaggaagcugugccaagggcuguuuuuucggguagaggagcgcaagaaguggcccgaacggcugucugcccucgauaaucuccucaaccauuccagcauguuccucaagggggcccggcucaucccagagauggaccagaucuucacugagguggagaugacaacguuagagaaagucaucaaugagaccugggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggccagacugaagaugcagagcccauuucagaaccugagaaaguagagacuggauccgagccaggagacacugagccuuuggaguuaggagguccuggagcagaaccugaacagaaagaacaaucgacaggacagaagcggccuuugaagaacgacgaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6092 - RNA, 2581 nt, Artificial Sequence
  mRNA product Design2 comprising derived and/or modified sequence from Homo sapiens__NP_005339.3 __HsHSP90AA1 (wt)
ggggcgcugccuacggagguggcagccaucuccuucucggcaucaagcuuaccaugccugaggaaacccagacccaagaccaaccgauggaggaggaggagguugagacguucgccuuucaggcagaaauugcccaguugaugucauugaucaucaauacuuucuacucgaacaaagagaucuuucugagagagcucauuucaaauucaucagaugcauuggacaaaauccgguaugagagcuugacagaucccaguaaauuagacucugggaaagagcugcauauuaaccuuauaccgaacaaacaagaucgaacucucacuauuguggauacuggaauuggaaugaccaaggcugacuugaucaauaaccuugguacuaucgccaagucugggaccaaagcguucauggaagcauugcaggcuggugcagauaucucuaugauuggccaguucgguguugguuuuuauucugcuuauuugguugcugagaaaguaacugugaucaccaaacauaacgaugaugagcaguacgcuugggaguccucagcagggggaucauucacagugaggacagacacaggugaaccuaugggucguggaacaaaaguuauccuacaccugaaagaagaccaaacugaguacuuggaggaacgaagaauaaaggagauugugaagaaacauucucaguuuauuggauaucccauuacucuuuuuguggagaaggaacgugauaaagaaguaagcgaugaugaggcugaagaaaaggaagacaaagaagaagaaaaagaaaaagaagagaaagagucggaagacaaaccugaaauugaagauguugguucugaugaggaagaagaaaagaaggauggugacaagaagaagaagaagaagauuaaggaaaaguacaucgaucaagaagaacucaacaaaacaaagcccaucuggaccagaaaucccgacgauauuacuaaugaggaguacggagaguucuauaagagcuugaccaaugacugggaagaucacuuggcagugaagcauuuuucaguugaaggacaguuggaguucagagcccuucuauuugucccacgacgugcuccuuuugaucuguuugaaaacagaaagaaaaagaacaacaucaaauuguauguacgcagaguuuucaucauggauaacugugaggagcuaaucccugaauaucugaacuucauuagaggggugguagacucggaggaucucccucuaaacauaucccgugagauguugcaacaaagcaaaauuuugaaaguuaucaggaagaauuuggucaaaaaaugcuuagaacucuuuacugaacuggcggaagauaaagagaacuacaagaaauucuaugagcaguucucuaaaaacauaaagcucggaauacacgaagacucucaaaaucggaagaagcucucagagcuguuaagguacuacacaucugccucuggugaugagaugguuucucucaaggacuacugcaccagaaugaaggagaaccagaaacauaucuauuauaucacaggugagaccaaggaccagguagcuaacucagccuuuguggaacgucuucggaaacauggcuuagaagugaucuauaugauugagcccauugaugaguacuguguccaacagcugaaggaauuugaggggaagacuuuagugucagucaccaaagaaggccuggaacuuccagaggaugaagaagagaaaaagaagcaggaagagaaaaaaacaaaguuugagaaccucugcaaaaucaugaaagacauauuggagaaaaaaguugaaaaggugguugugucaaaccgauuggugacaucuccaugcuguauugucacaagcacauauggcuggacagcaaacauggagagaaucaugaaagcucaagcccuaagagacaacucaacaauggguuacauggcagcaaagaaacaccuggagauaaacccugaccauuccauuauugagaccuuaaggcaaaaggcagaggcugauaagaacgacaagucugugaaggaucuggucaucuugcuuuaugaaacugcgcuccugucuucuggcuucagucuggaagauccccagacacaugcuaacaggaucuacaggaugaucaaacuuggucuggguauugaugaagaugacccuacugcugaugauaccagugcugcuguaacugaagaaaugccaccccuugaaggagaugacgacacaucacgcauggaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6093 - RNA, 721 nt, Artificial Sequence
  mRNA product Design2 comprising derived and/or modified sequence from Homo sapiens__NG_005218__HsHSP90AA3P (wt)
ggggcgcugccuacggagguggcagccaucuccuucucggcaucaagcuuaccauggauuccaguaaauuagacucugggaaagggcugcauauuaaccuuguaccaaacaaacaaaaucaaacccucacuauuguggacacuagaauuggaaugaccaagacugacuugaucaauaaccucgguacugucaccaagucugggaccaaagcauucauggaagcauugcaggcugaugcagauaucucuaugauuggccauuucgggguugguuuuuauucugcuuauuugguugccaagaaaguaacugugaucagcaaacauaacaaugaugagcaguacaccugggaguccucagcagggggaucauucacagugaggacagacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6094 - RNA, 2557 nt, Artificial Sequence
  mRNA product Design2 comprising derived and/or modified sequence from Homo sapiens__NP_031381.2__HsHSP90AB1 (wt)
ggggcgcugccuacggagguggcagccaucuccuucucggcaucaagcuuaccaugccugaggaagugcaccauggagaggaggagguggagacuuuugccuuucaggcagaaauugcccaacucaugucccucaucaucaauaccuucuauuccaacaaggagauuuuccuucgggaguugaucucuaaugcuucugaugccuuggacaagauucgcuaugagagccugacagacccuucgaaguuggacagugguaaagagcugaaaauugacaucauccccaacccucaggaacguacccugacuuugguagacacaggcauuggcaugaccaaagcugaucucauaaauaauuugggaaccauugccaagucugguacuaaagcauucauggaggcucugcaggcuggugcagacaucuccaugauugggcaguuugguguuggcuuuuauucugccuacuugguggcagagaaagugguugugaucacaaagcacaacgaugaugaacaguaugcuugggagucuucugcuggagguuccuucacugugcgugcugaccauggugagcccauuggcagggguaccaaagugauccuccaucuuaaagaagaucagacagaguaccuagaagagaggcgggucaaagaaguagugaagaagcauucucaguucauaggcuaucccaucacccuuuauuuggagaaggaacgagagaaggaaauuagugaugaugaggcagaggaagagaaaggugagaaagaagaggaagauaaagaugaugaagaaaaacccaagaucgaagauguggguucagaugaggaggaugacagcgguaaggauaagaagaagaaaacuaagaagaucaaagagaaauacauugaucaggaagaacuaaacaagaccaagccuauuuggaccagaaacccugaugacaucacccaagaggaguauggagaguucuacaagagccucacuaaugacugggaagaccacuuggcagucaagcacuuuucuguagaaggucaguuggaguucagggcauugcuauuuauuccucgucgggcucccuuugaccuuuuugagaacaagaagaaaaagaacaacaucaaacucuauguccgccguguguucaucauggacagcugugaugaguugauaccagaguaucucaauuuuauccguggugugguugacucugaggaucugccccugaacaucucccgagaaaugcuccagcagagcaaaaucuugaaagucauucgcaaaaacauuguuaagaagugccuugagcuguucucugagcuggcagaagacaaggagaauuacaagaaauucuaugaggcauucucuaaaaaucucaagcucggaauccacgaagacuccacuaaccgccgccgccugucugagcugcugcgcuaucauaccucccagucuggagaugagaugacaucucugucagaguauguuucucgcaugaaggagacacagaaguccaucuauuacaucacuggugagagcaaagagcaggucgccaacucagcuuuuguggagcgagugcggaaacggggcuucgaggugguauauaugaccgagcccauugacgaguacugugugcagcagcucaaggaauuugaugggaaaagccuggucucaguuaccaaggagggucuggagcugccugaggaugaggaggagaagaagaagauggaagagagcaaggcaaaguuugagaaccucugcaagcucaugaaagaaaucuuagauaagaagguugagaaggugacaaucuccaauagacuugugucuucaccuugcugcauugugaccagcaccuacggcuggacagccaauauggagcggaucaugaaagcccaggcacuucgggacaacuccaccaugggcuauaugauggccaaaaagcaccuggagaucaacccugaccaccccauuguggagacgcugcggcagaaggcugaggccgacaagaaugauaaggcaguuaaggaccugguggugcugcuguuugaaaccgcccugcuaucuucuggcuuuucccuugaggauccccagacccacuccaaccgcaucuaucgcaugaucaagcuaggucuagguauugaugaagaugaaguggcagcagaggaacccaaugcugcaguuccugaugagauccccccucucgagggcgaugaggaugcgucucgcauggaagaagucgauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6095 - RNA, 2794 nt, Artificial Sequence
  mRNA product Design2 comprising derived and/or modified sequence from Homo sapiens__NP_003290.1__HsHSP90B1 (wt)
ggggcgcugccuacggagguggcagccaucuccuucucggcaucaagcuuaccaugagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcauucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcugguucguaaaacgcuggacaugaucaagaagauugcugaugauaaauacaaugauacuuuuuggaaagaauuugguaccaacaucaagcugggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagaacccgaagaagaaccugaagagacagcagaagacacaacagaagacacagagcaagacgaagaugaagaaauggaugugggaacagaugaagaagaagaaacagcaaaggaaucuacagcugaaaaagaugaauuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6096 - RNA, 2497 nt, Artificial Sequence
  mRNA product Design2 comprising derived and/or modified sequence from Homo sapiens__NP_057376.2__HsTRAP1 (wt)
ggggcgcugccuacggagguggcagccaucuccuucucggcaucaagcuuaccauggcgcgcgagcugcgggcgcugcugcuguggggccgccgccugcggccuuugcugcgggcgccggcgcuggcggccgugccgggaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguuccacuuccaaacaugaguuccaggccgagacaaagaagcuguuggacauuguugcccggucccuguacucagaaaaagagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccaggauacugguaucgggaugacacaggaagaacugguguccaaccuggggacgauugccagaucggggucaaaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugguucuggaguguuugaaaucgccgaagcaucgggaguuagaaccgggacaaaaaucaucauccaccugaaauccgacugcaaggaguuuuccagcgaggcccgggugcgagaugugguaacgaaguacagcaacuucgucagcuuccccuuguacuugaauggaaggcggaugaacaccuugcaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacaugaaaccguccauguuugaugugagccgggagcugggcuccagcguugcacuguacagccgcaaaguccucauccagaccaaggccacggacauccugcccaaguggcugcgcuucauccgaggugugguggacagugaggacauuccccugaaccucagccgggagcugcugcaggagagcgcacucaucaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagagguucucuucugcuuugagcaguuugaugagcucacccugcugcaccuucgugaguuugacaagaagaagcugaucucuguggagacggacauagucguggaucacuacaaggaggagaaguuugaggacagguccccagccgccgagugccuaucagagaaggagacggaggagcucauggccuggaugagaaaugugcuggggucgcgugucaccaacgugaaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggcacgcgcucaucaagaagcugaaucagcugcgcgcaagcgagccuggccuggcucagcugcugguggaucagauauacgagaacgccaugauugcugcuggacuuguugacgacccuagggccauggugggccgcuugaaugagcugcuugucaaggcccuggagcgacacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6097 - RNA, 844 nt, Artificial Sequence
  mRNA product Design2 comprising derived and/or modified sequence from Homo sapiens__NP_000609.1__HsIGF1 (wt)
ggggcgcugccuacggagguggcagccaucuccuucucggcaucaagcuuaccaugggaaaaaucagcagucuuccaacccaauuauuuaagugcugcuuuugugauuucuugaaggugaagaugcacaccauguccuccucgcaucucuucuaccuggcgcugugccugcucaccuucaccagcucugccacggcuggaccggagacgcucugcggggcugagcugguggaugcucugcaguucguguguggagacaggggcuuuuauuucaacaagcccacaggguauggcuccagcagucggagggcgccucagacaggcaucguggaugagugcugcuuccggagcugugaucuaaggaggcuggagauguauugcgcaccccucaagccugccaagucagcucgcucuguccgugcccagcgccacaccgacaugcccaagacccagaaggaaguacauuugaagaacgcaaguagagggagugcaggaaacaagaacuacaggauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6098 - RNA, 1021 nt, Artificial Sequence
  mRNA product Design2 comprising derived and/or modified sequence from Homo sapiens__NP_000591.1__HsIL6 (wt)
ggggcgcugccuacggagguggcagccaucuccuucucggcaucaagcuuaccaugaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcugugcagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucugcggcaaauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6099 - RNA, 1663 nt, Artificial Sequence
  mRNA product Design2 comprising derived and/or modified sequence from Homo sapiens__NP_002183.1__HsINHBA (wt)
ggggcgcugccuacggagguggcagccaucuccuucucggcaucaagcuuaccaugcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcugcaugugggcaaagucggggagaacggguauguggagauagaggaugacauuggaaggagggcagaaaugaaugaacuuauggagcagaccucggagaucaucacguuugccgagucaggaacagccaggaagacgcugcacuucgagauuuccaaggaaggcagugaccugucagugguggagcgugcagaagucuggcuguuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaaaagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6100 - RNA, 3841 nt, Artificial Sequence
  mRNA product Design2 comprising derived and/or modified sequence from Homo sapiens__NP_000623.2__HsITGAM (wt)
ggggcgcugccuacggagguggcagccaucuccuucucggcaucaagcuuaccauggcucucagaguccuucuguuaacagccuugaccuuaugucauggguucaacuuggacacugaaaacgcaaugaccuuccaagagaacgcaaggggcuucgggcagagcgugguccagcuucagggauccaggguggugguuggagccccccaggagauaguggcugccaaccaaaggggcagccucuaccagugcgacuacagcacaggcucaugcgagcccauccgccugcagguccccguggaggccgugaacaugucccugggccugucccuggcagccaccaccagccccccucagcugcuggccuguggucccaccgugcaccagacuugcagugagaacacguaugugaaagggcucugcuuccuguuuggauccaaccuacggcagcagccccagaaguucccagaggcccuccgaggguguccucaagaggauagugacauugccuucuugauugauggcucugguagcaucaucccacaugacuuucggcggaugaaggaguuugucucaacugugauggagcaauuaaaaaaguccaaaaccuuguucucuuugaugcaguacucugaagaguuccggauucacuuuaccuucaaagaguuccagaacaacccuaacccaagaucacuggugaagccaauaacgcagcugcuugggcggacacacacggccacgggcauccgcaaagugguacgagagcuguuuaacaucaccaacggagcccgaaagaaugccuuuaagauccuaguugucaucacggauggagaaaaguuuggcgaucccuugggauaugaggaugucaucccugaggcagacagagagggagucauucgcuacgucauuggggugggagaugccuuccgcagugagaaaucccgccaagagcuuaauaccaucgcauccaagccgccucgugaucacguguuccaggugaauaacuuugaggcucugaagaccauucagaaccagcuucgggagaagaucuuugcgaucgaggguacucagacaggaaguagcagcuccuuugagcaugagaugucucaggaaggcuucagcgcugccaucaccucuaauggccccuugcugagcacuguggggagcuaugacugggcugguggagucuuucuauauacaucaaaggagaaaagcaccuucaucaacaugaccagaguggauucagacaugaaugaugcuuacuuggguuaugcugccgccaucaucuuacggaaccgggugcaaagccugguucugggggcaccucgauaucagcacaucggccugguagcgauguucaggcagaacacuggcaugugggaguccaacgcuaaugucaagggcacccagaucggcgccuacuucggggccucccucugcuccguggacguggacagcaacggcagcaccgaccugguccucaucggggccccccauuacuacgagcagacccgagggggccagguguccgugugccccuugcccagggggagggcucgguggcagugugaugcuguucucuacggggagcagggccaacccuggggccgcuuuggggcagcccuaacagugcugggggacguaaauggggacaagcugacggacguggccauuggggccccaggagaggaggacaaccggggugcuguuuaccuguuucacggaaccucaggaucuggcaucagccccucccauagccagcggauagcaggcuccaagcucucucccaggcuccaguauuuuggucagucacugagugggggccaggaccucacaauggauggacugguagaccugacuguaggagcccaggggcacgugcugcugcucaggucccagccaguacugagagucaaggcaaucauggaguucaaucccagggaaguggcaaggaauguauuugaguguaaugaucagguggugaaaggcaaggaagccggagaggucagagucugccuccauguccagaaaagcacacgggaucggcuaagagaaggacagauccagaguguugugacuuaugaccuggcucuggacuccggccgcccacauucccgcgccgucuucaaugagacaaagaacagcacacgcagacagacacaggucuuggggcugacccagacuugugagacccugaaacuacaguugccgaauugcaucgaggacccagugagccccauugugcugcgccugaacuucucucuggugggaacgccauugucugcuuucgggaaccuccggccagugcuggcggaggaugcucagagacucuucacagccuuguuucccuuugagaagaauuguggcaaugacaacaucugccaggaugaccucagcaucaccuucaguuucaugagccuggacugccucguggugggugggccccgggaguucaacgugacagugacugugagaaaugauggugaggacuccuacaggacacaggucaccuucuucuucccgcuugaccuguccuaccggaagguguccacgcuccagaaccagcgcucacagcgauccuggcgccuggccugugagucugccuccuccaccgaagugucuggggccuugaaaagcaccagcugcagcauaaaccaccccaucuucccggaaaacucagaggucaccuuuaauaucacguuugauguagacucuaaggcuucccuuggaaacaaacugcuccucaaggccaaugugaccagugagaacaacaugcccagaaccaacaaaaccgaguuccaacuggagcugccggugaaauaugcugucuacaugguggucaccagccauggggucuccacuaaauaucucaacuucacggccucagagaauaccagucgggucaugcagcaucaauaucaggucagcaaccuggggcagaggagccuccccaucagccugguguucuuggugcccguccggcugaaccagacugucauaugggaccgcccccaggucaccuucuccgagaaccucucgaguacgugccacaccaaggagcgcuugcccucucacuccgacuuucuggcugagcuucggaaggcccccguggugaacugcuccaucgcugucugccagagaauccagugugacaucccguucuuuggcauccaggaagaguucaaugcuacccucaaaggcaaccucucguuugacugguacaucaagaccucgcauaaccaccuccugaucgugagcacagcugagaucuuguuuaacgauuccguguucacccugcugccgggacagggggcguuugugaggucccagacggagaccaaaguggagccguucgagguccccaacccccugccgcucaucgugggcagcucugucgggggacugcugcuccuggcccucaucaccgccgcgcuguacaagcucggcuucuucaagcggcaauacaaggacaugaugagugaagggggucccccgggggccgaaccccaguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6101 - RNA, 1786 nt, Artificial Sequence
  mRNA product Design2 comprising derived and/or modified sequence from Homo sapiens__NP_002415.1__HsMMP8 (wt)
ggggcgcugccuacggagguggcagccaucuccuucucggcaucaagcuuaccauguucucccugaagacgcuuccauuucugcucuuacuccaugugcagauuuccaaggccuuuccuguaucuucuaaagagaaaaauacaaaaacuguucaggacuaccuggaaaaguucuaccaauuaccaagcaaccaguaucagucuacaaggaagaauggcacuaaugugaucguugaaaagcugaaagaaaugcagcgauuuuuuggguugaaugugacggggaagccaaaugaggaaacucuggacaugaugaaaaagccucgcuguggagugccugacaguggugguuuuauguuaaccccaggaaaccccaagugggaacgcacuaacuugaccuacaggauucgaaacuauaccccacagcugucagaggcugagguagaaagagcuaucaaggaugccuuugaacucuggaguguugcaucaccucucaucuucaccaggaucucacagggagaggcagauaucaacauugcuuuuuaccaaagagaucacggugacaauucuccauuugauggacccaauggaauccuugcucaugccuuucagccaggccaagguauuggaggagaugcucauuuugaugccgaagaaacauggaccaacaccuccgcaaauuacaacuuguuucuuguugcugcucaugaauuuggccauucuuuggggcucgcucacuccucugacccuggugccuugauguaucccaacuaugcuuucagggaaaccagcaacuacucacucccucaagaugacaucgauggcauucaggccaucuauggacuuucaagcaacccuauccaaccuacuggaccaagcacacccaaacccugugaccccaguuugacauuugaugcuaucaccacacuccguggagaaauacuuuucuuuaaagacagguacuucuggagaaggcauccucagcuacaaagagucgaaaugaauuuuauuucucuauucuggccaucccuuccaacugguauacaggcugcuuaugaagauuuugacagagaccucauuuuccuauuuaaaggcaaccaauacugggcucugaguggcuaugauauucugcaagguuaucccaaggauauaucaaacuauggcuuccccagcagcguccaagcaauugacgcagcuguuuucuacagaaguaaaacauacuucuuuguaaaugaccaauucuggagauaugauaaccaaagacaauucauggagccagguuaucccaaaagcauaucaggugccuuuccaggaauagagaguaaaguugaugcaguuuuccagcaagaacauuucuuccaugucuucaguggaccaagauauuacgcauuugaucuuauugcucagagaguuaccagaguugcaagaggcaauaaauggcuuaacuguagauauggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6102 - RNA, 2506 nt, Artificial Sequence
  mRNA product Design2 comprising derived and/or modified sequence from Homo sapiens__NP_004985.2__HsMMP9 (wt)
ggggcgcugccuacggagguggcagccaucuccuucucggcaucaagcuuaccaugagccucuggcagccccugguccuggugcuccuggugcugggcugcugcuuugcugcccccagacagcgccaguccacccuugugcuguucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcuguucggcuucugcccgacccgagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuguucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6103 - RNA, 1450 nt, Artificial Sequence
  mRNA product Design2 comprising derived and/or modified sequence from Homo sapiens__NP_001286.1__HsCCR1 (wt)
ggggcgcugccuacggagguggcagccaucuccuucucggcaucaagcuuaccauggaaacuccaaacaccacagaggacuaugacacgaccacagaguuugacuauggggaugcaacuccgugccagaaggugaacgagagggccuuuggggcccaacugcugcccccucuguacuccuugguauuugucauuggccugguuggaaacauccuggugguccugguccuugugcaauacaagaggcuaaaaaacaugaccagcaucuaccuccugaaccuggccauuucugaccugcuguuccuguucacgcuucccuucuggaucgacuacaaguugaaggaugacuggguuuuuggugaugccauguguaagauccucucuggguuuuauuacacaggcuuguacagcgagaucuuuuucaucauccugcugacgauugacagguaccuggccaucguccacgccguguuugccuugcgggcacggaccgucacuuuuggugucaucaccagcaucaucauuugggcccuggccaucuuggcuuccaugccaggcuuauacuuuuccaagacccaaugggaguucacucaccacaccuguagccuucacuuuccucacgaaagccuacgagaguggaagcuguuucaggcucugaaacugaaccucuuugggcugguauugccuuuguuggucaugaucaucugcuacacagggauuauaaagauucugcuaagacgaccaaaugagaagaaauccaaagcuguccguuugauuuuugucaucaugaucaucuuuuuucucuuuuggacccccuacaauuugacuauacuuauuucuguuuuccaagacuuccuguucacccaugagugugagcagagcagacauuuggaccuggcugugcaagugacggaggugaucgccuacacgcacugcugugucaacccagugaucuacgccuucguuggugagagguuccggaaguaccugcggcaguuguuccacaggcguguggcugugcaccugguuaaauggcuccccuuccucuccguggacaggcuggagagggucagcuccacaucucccuccacaggggagcaugaacucucugcuggguucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6104 - RNA, 1108 nt, Artificial Sequence
  mRNA product Design2 comprising derived and/or modified sequence from Homo sapiens__NP_002599.1__HsPDGFB (wt)
ggggcgcugccuacggagguggcagccaucuccuucucggcaucaagcuuaccaugaaucgcugcugggcgcuguuccugucucucugcugcuaccugcgucuggucagcgccgagggggaccccauucccgaggagcuuuaugagaugcugagugaccacucgauccgcuccuuugaugaucuccaacgccugcugcacggagaccccggagaggaagauggggccgaguuggaccugaacaugacccgcucccacucuggaggcgagcuggagagcuuggcucguggaagaaggagccuggguucccugaccauugcugagccggccaugaucgccgagugcaagacgcgcaccgagguguucgagaucucccggcgccucauagaccgcaccaacgccaacuuccugguguggccgcccuguguggaggugcagcgcugcuccggcugcugcaacaaccgcaacgugcagugccgccccacccaggugcagcugcgaccuguccaggugagaaagaucgagauugugcggaagaagccaaucuuuaagaaggccacggugacgcuggaagaccaccuggcaugcaagugugagacaguggcagcugcacggccugugacccgaagcccgggggguucccaggagcagcgagccaaaacgccccaaacucgggugaccauucggacggugcgaguccgccggccccccaagggcaagcaccggaaauucaagcacacgcaugacaagacggcacugaaggagacccuuggagccuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6105 - RNA, 1477 nt, Artificial Sequence
  mRNA product Design2 comprising derived and/or modified sequence from Homo sapiens__NP_149126.1__HsPDGFD (wt)
ggggcgcugccuacggagguggcagccaucuccuucucggcaucaagcuuaccaugcaccggcucaucuuugucuacacucuaaucugcgcaaacuuuugcagcugucgggacacuucugcaaccccgcagagcgcauccaucaaagcauugcgcaacgccaaccucaggcgagaugacuuguaccgaagagaugagaccauccaggugaaaggaaacggcuacgugcagaguccuagauucccgaacagcuaccccaggaaccugcuccugacauggcggcuucacucucaggagaauacacggauacagcuaguguuugacaaucaguuuggauuagaggaagcagaaaaugauaucuguagguaugauuuuguggaaguugaagauauauccgaaaccaguaccauuauuagaggacgaugguguggacacaaggaaguuccuccaaggauaaaaucaagaacgaaccaaauuaaaaucacauucaaguccgaugacuacuuuguggcuaaaccuggauucaagauuuauuauucuuugcuggaagauuuccaacccgcagcagcuucagagaccaacugggaaucugucacaagcucuauuucagggguauccuauaacucuccaucaguaacggaucccacucugauugcggaugcucuggacaaaaaaauugcagaauuugauacaguggaagaucugcucaaguacuucaauccagagucauggcaagaagaucuugagaauauguaucuggacaccccucgguaucgaggcaggucauaccaugaccggaagucaaaaguugaccuggauaggcucaaugaugaugccaagcguuacaguugcacucccaggaauuacucggucaauauaagagaagaacugaaguuggccaauguggucuucuuuccacguugccuccucgugcagcgcuguggaggaaauuguggcuguggaacugucaacuggagguccugcacaugcaauucagggaaaaccgugaaaaaguaucaugagguauuacaguuugagccuggccacaucaagaggagggguagagcuaagaccauggcucuaguugacauccaguuggaucaccaugaacgaugugauuguaucugcagcucaagaccaccucgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6106 - RNA, 1060 nt, Artificial Sequence
  mRNA product Design2 comprising derived and/or modified sequence from Homo sapiens__NP_003946.3__HsSOCS3 (wt)
ggggcgcugccuacggagguggcagccaucuccuucucggcaucaagcuuaccauggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagggccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6107 - RNA, 1555 nt, Artificial Sequence
  mRNA product Design2 comprising derived and/or modified sequence from Homo sapiens__NP_000651.3__HsTGFB1 (wt)
ggggcgcugccuacggagguggcagccaucuccuucucggcaucaagcuuaccaugccgcccuccgggcugcggcugcugccgcugcugcuaccgcugcuguggcuacuggugcugacgccuggccggccggccgcgggacuauccaccuguaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacgaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccagaaauacagcaacaauuccuggcgauaccucagcaaccggcugcuggcacccagcgacucgccagagugguuaucuuuugaugucaccggaguugugcggcagugguugagccguggaggggaaauugagggcuuucgccuuagcgcccacugcuccugugacagcagggauaacacacugcaaguggacaucaacggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6108 - RNA, 1627 nt, Artificial Sequence
  mRNA product Design2 comprising derived and/or modified sequence from Homo sapiens__NP_003229.1__HsTGFB2 (wt)
ggggcgcugccuacggagguggcagccaucuccuucucggcaucaagcuuaccaugcacuacugugugcugagcgcuuuucugauccugcaucuggucacggucgcgcucagccugucuaccugcagcacacucgauauggaccaguucaugcgcaagaggaucgaggcgauccgcgggcagauccugagcaagcugaagcucaccagucccccagaagacuauccugagcccgaggaaguccccccggaggugauuuccaucuacaacagcaccagggacuugcuccaggagaaggcgagccggagggcggccgccugcgagcgcgagaggagcgacgaagaguacuacgccaaggagguuuacaaaauagacaugccgcccuucuuccccuccgaaaaugccaucccgcccacuuucuacagacccuacuucagaauuguucgauuugacgucucagcaauggagaagaaugcuuccaauuuggugaaagcagaguucagagucuuucguuugcagaacccaaaagccagagugccugaacaacggauugagcuauaucagauucucaaguccaaagauuuaacaucuccaacccagcgcuacaucgacagcaaaguugugaaaacaagagcagaaggcgaauggcucuccuucgauguaacugaugcuguucaugaauggcuucaccauaaagacaggaaccugggauuuaaaauuagcuuacacugucccugcugcacuuuuguaccaucuaauaauuacaucaucccaaauaaaagugaagaacuagaagcaagauuugcagguauugauggcaccuccacauauaccaguggugaucagaaaacuauaaaguccacuaggaaaaaaaacagugggaagaccccacaucuccugcuaauguuauugcccuccuacagacuugagucacaacagaccaaccggcggaagaagcgugcuuuggaugcggccuauugcuuuagaaaugugcaggauaauugcugccuacguccacuuuacauugauuucaagagggaucuaggguggaaauggauacacgaacccaaaggguacaaugccaacuucugugcuggagcaugcccguauuuauggaguucagacacucagcacagcaggguccugagcuuauauaauaccauaaauccagaagcaucugcuucuccuugcugcgugucccaagauuuagaaccucuaaccauucucuacuacauuggcaaaacacccaagauugaacagcuuucuaauaugauuguaaagucuugcaaaugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6109 - RNA, 1621 nt, Artificial Sequence
  mRNA product Design2 comprising derived and/or modified sequence from Homo sapiens__NP_003230.1__HsTGFB3 (wt)
ggggcgcugccuacggagguggcagccaucuccuucucggcaucaagcuuaccaugaagaugcacuugcaaagggcucuggugguccuggcccugcugaacuuugccacggucagccucucucuguccacuugcaccaccuuggacuucggccacaucaagaagaagaggguggaagccauuaggggacagaucuugagcaagcucaggcucaccagccccccugagccaacggugaugacccacguccccuaucagguccuggcccuuuacaacagcacccgggagcugcuggaggagaugcauggggagagggaggaaggcugcacccaggaaaacaccgagucggaauacuaugccaaagaaauccauaaauucgacaugauccaggggcuggcggagcacaacgaacuggcugucugcccuaaaggaauuaccuccaagguuuuccgcuucaauguguccucaguggagaaaaauagaaccaaccuauuccgagcagaguuccgggucuugcgggugcccaaccccagcucuaagcggaaugagcagaggaucgagcuguuccagauccuucggccagaugagcacauugccaaacagcgcuauaucgguggcaagaaucugcccacacggggcacugccgaguggcuguccuuugaugucacugacacugugcgugaguggcuguugagaagagaguccaacuuaggucuagaaaucagcauucacuguccaugucacaccuuucagcccaauggagauauccuggaaaacauucacgaggugauggaaaucaaauucaaaggcguggacaaugaggaugaccauggccguggagaucuggggcgccucaagaagcagaaggaucaccacaacccucaucuaauccucaugaugauucccccacaccggcucgacaacccgggccaggggggucagaggaagaagcgggcuuuggacaccaauuacugcuuccgcaacuuggaggagaacugcugugugcgcccccucuacauugacuuccgacaggaucugggcuggaaguggguccaugaaccuaagggcuacuaugccaacuucugcucaggcccuugcccauaccuccgcagugcagacacaacccacagcacggugcugggacuguacaacacucugaacccugaagcaucugccucgccuugcugcgugccccaggaccuggagccccugaccauccuguacuauguugggaggacccccaaaguggagcagcucuccaacaugguggugaagucuuguaaauguagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6110 - RNA, 1768 nt, Artificial Sequence
  mRNA product Design2 comprising derived and/or modified sequence from Homo sapiens__NP_001057.1__HsTNFRSF1B (wt)
ggggcgcugccuacggagguggcagccaucuccuucucggcaucaagcuuaccauggcgcccgucgccgucugggccgcgcuggccgucggacuggagcucugggcugcggcgcacgccuugcccgcccagguggcauuuacacccuacgccccggagcccgggagcacaugccggcucagagaauacuaugaccagacagcucagaugugcugcagcaaaugcucgccgggccaacaugcaaaagucuucuguaccaagaccucggacaccgugugugacuccugugaggacagcacauacacccagcucuggaacuggguucccgagugcuugagcuguggcucccgcuguagcucugaccagguggaaacucaagccugcacucgggaacagaaccgcaucugcaccuguaggcccggcugguacugcgcgcugagcaagcaggaggggugccggcugugcgcgccgcugcgcaagugccgcccgggcuucggcguggccagaccaggaacugaaacaucagacguggugugcaagcccugugccccggggacguucuccaacacgacuucauccacggauauuugcaggccccaccagaucuguaacgugguggccaucccugggaaugcaagcauggaugcagucugcacguccacgucccccacccggaguauggccccaggggcaguacacuuaccccagccaguguccacacgaucccaacacacgcagccaacuccagaacccagcacugcuccaagcaccuccuuccugcucccaaugggccccagccccccagcugaagggagcacuggcgacuucgcucugccaguuggacugauugugggugugacagccuugggucuacuaauaauaggaguggugaacugugucaucaugacccaggugaaaaagaagcccuugugccugcagagagaagccaaggugccucacuugccugccgauaaggcccgggguacacagggccccgagcagcagcaccuccugaucacagcgccgagcuccagcagcagcucccuggagagcucggccagugcguuggacagaagggcgcccacucggaaccagccacaggcaccaggcguggaggccaguggggccggggaggcccgggccagcaccgggagcucagauucuuccccugguggccaugggacccaggucaaugucaccuguaucgugaacgucuguagcagcucugaccacagcucacagugcuccucccaagccagcuccacaaugggagacacagauuccagccccucggaguccccgaaggacgagcagguccccuucuccaaggaggaaugugccuuucggucacagcuggagacgccagagacccugcuggggagcaccgaagagaagccccugccccuuggagugccugaugcugggaugaagcccaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6111 - RNA, 1447 nt, Artificial Sequence
  mRNA product Design2 comprising derived and/or modified sequence from Homo sapiens__NP_004460.1__HsVEGFD (wt)
ggggcgcugccuacggagguggcagccaucuccuucucggcaucaagcuuaccauguacagagaguggguaguggugaauguuuucaugauguuguacguccagcuggugcagggcuccaguaaugaacauggaccagugaagcgaucaucucaguccacauuggaacgaucugaacagcagaucagggcugcuucuaguuuggaggaacuacuucgaauuacucacucugaggacuggaagcuguggagaugcaggcugaggcucaaaaguuuuaccaguauggacucucgcucagcaucccaucgguccacuagguuugcggcaacuuucuaugacauugaaacacuaaaaguuauagaugaagaauggcaaagaacucagugcagcccuagagaaacgugcguggagguggccagugagcuggggaagaguaccaacacauucuucaagcccccuugugugaacguguuccgaugugguggcuguugcaaugaagagagccuuaucuguaugaacaccagcaccucguacauuuccaaacagcucuuugagauaucagugccuuugacaucaguaccugaauuagugccuguuaaaguugccaaucauacagguuguaagugcuugccaacagccccccgccauccauacucaauuaucagaagauccauccagaucccugaagaagaucgcuguucccauuccaagaaacucuguccuauugacaugcuaugggauagcaacaaauguaaauguguuuugcaggaggaaaauccacuugcuggaacagaagaccacucucaucuccaggaaccagcucucugugggccacacaugauguuugacgaagaucguugcgagugugucuguaaaacaccaugucccaaagaucuaauccagcaccccaaaaacugcaguugcuuugagugcaaagaaagucuggagaccugcugccagaagcacaagcuauuucacccagacaccuguagcugugaggacagaugccccuuucauaccagaccaugugcaaguggcaaaacagcaugugcaaagcauugccgcuuuccaaaggagaaaagggcugcccaggggccccacagccgaaagaauccuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6112 - RNA, 881 nt, Artificial Sequence
  mRNA product Design3 comprising derived and/or modified sequence from Sus scrofa__P45561-2__SsAMELX-001-2 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuauauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6113 - RNA, 917 nt, Artificial Sequence
  mRNA product Design3 comprising derived and/or modified sequence from Sus scrofa__NP_998965.1__SsAMELX-001-3 (wt)
gggagagucccgcagucggcguccagcggcucugcuuguucgugugugugucguugcaggccuuauucaagcuuaccauggggaccuggauuuucuuugccugccuuuugggagcaucccuugcuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6114 - RNA, 566 nt, Artificial Sequence
  mRNA product Design3 comprising derived and/or modified sequence from Sus scrofa__K7GPB2__SsAMELX-002 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6115 - RNA, 959 nt, Artificial Sequence
  mRNA product Design3 comprising derived and/or modified sequence from Sus scrofa__K7GLD0__SsAMELX-003 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggacuuauacuuggaggcuauccguauugacaggacugcauucgugcuuaccccucugaagugguaccagaacaugauaagacauccguacacuuccuaugguuacgaacccauggguggauggcugcaccaccaaaucauucccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6116 - RNA, 845 nt, Artificial Sequence
  mRNA product Design3 comprising derived and/or modified sequence from Sus scrofa__K7GPE9__SsAMELX-004 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6117 - RNA, 869 nt, Artificial Sequence
  mRNA product Design3 comprising derived and/or modified sequence from Sus scrofa__J9JIM4__SsAMELX-201 (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6118 - RNA, 3308 nt, Artificial Sequence
  mRNA product Design3 comprising derived and/or modified sequence from Homo sapiens__NP_006120.1__HsBMP1 (wt)
gggagagucccgcagucggcguccagcggcucugcuuguucgugugugugucguugcaggccuuauucaagcuuaccaugcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcggcugccuuucuuggggacauugcccuggacgaagaggaccugagggccuuccagguacagcaggcuguggaucucagacggcacacagcucguaaguccuccaucaaagcugcaguuccaggaaacacuucuacccccagcugccagagcaccaacgggcagccucagaggggagccugugggagauggagagguagaucccguagccggcgggcggcgacgucccgaccagagcguguguggcccgauggggucauccccuuugucauugggggaaacuucacugguagccagagggcagucuuccggcaggccaugaggcacugggagaagcacaccugugucaccuuccuggagcgcacugacgaggacagcuauauuguguucaccuaucgaccuugcgggugcugcuccuacgugggucgccgcggcgggggcccccaggccaucuccaucggcaagaacugugacaaguucggcauugugguccacgagcugggccacgucgucggcuucuggcacgaacacacucggccagaccgggaccgccacguuuccaucguucgugagaacauccagccagggcaggaguauaacuuccugaagauggagccucaggagguggagucccugggggagaccuaugacuucgacagcaucaugcauuacgcucggaacacauucuccaggggcaucuuccuggauaccauuguccccaaguaugaggugaacggggugaaaccucccauuggccaaaggacacggcucagcaagggggacauugcccaagcccgcaagcuguacaagugcccagccuguggagagacccugcaagacagcacaggcaacuucuccuccccugaauaccccaauggcuacucugcucacaugcacugcguguggcgcaucucugucacacccggggagaagaucauccugaacuucacgucccuggaccuguaccgcagccgccugugcugguacgacuauguggagguccgagauggcuucuggaggaaggcgccccuccgaggccgcuucugcggguccaaacucccugagccuaucgucuccacugacagccgccucuggguugaguuccgcagcagcagcaauuggguuggaaagggcuucuuugcagucuacgaagccaucugcgggggugaugugaaaaaggacuauggccacauucaaucgcccaacuacccagacgauuaccggcccagcaaagucugcaucuggcggauccaggugucugagggcuuccacgugggccucacauuccaguccuuugagauugagcgccacgacagcugugccuacgacuaucuggaggugcgcgacgggcacagugagagcagcacccucaucgggcgcuacuguggcuaugagaagccugaugacaucaagagcacguccagccgccucuggcucaaguucgucucugacggguccauuaacaaagcgggcuuugccgucaacuuuuucaaagagguggacgagugcucucggcccaaccgcgggggcugugagcagcggugccucaacacccugggcagcuacaagugcagcugugaccccggguacgagcuggccccagacaagcgccgcugugaggcugcuuguggcggauuccucaccaagcucaacggcuccaucaccagcccgggcuggcccaaggaguacccccccaacaagaacugcaucuggcagcugguggcccccacccaguaccgcaucucccugcaguuugacuucuuugagacagagggcaaugaugugugcaaguacgacuucguggaggugcgcaguggacucacagcugacuccaagcugcauggcaaguucugugguucugagaagcccgaggucaucaccucccaguacaacaacaugcgcguggaguucaaguccgacaacaccguguccaaaaagggcuucaaggcccacuucuucucagacaaggacgagugcuccaaggauaacggcggcugccagcaggacugcgucaacacguucggcaguuaugagugccaaugccgcaguggcuucguccuccaugacaacaagcacgacugcaaagaagccggcugugaccacaaggugacauccaccagugguaccaucaccagccccaacuggccugacaaguaucccagcaagaaggagugcacgugggccaucuccagcacccccgggcaccgggucaagcugaccuucauggagauggacaucgagucccagccugagugugccuacgaccaccuagagguguucgacgggcgagacgccaaggcccccguccucggccgcuucugugggagcaagaagcccgagcccguccuggccacaggcagccgcauguuccugcgcuucuacucagauaacucgguccagcgaaagggcuuccaggccucccacgccacagagugcgggggccagguacgggcagacgugaagaccaaggaccuuuacucccacgcccaguuuggcgacaacaacuacccuggggguguggacugugagugggucauuguggccgaggaaggcuacggcguggagcucguguuccagaccuuugagguggaggaggagaccgacugcggcuaugacuacauggagcuguucgacggcuacgacagcacagcccccaggcuggggcgcuacuguggcucagggccuccugaggagguguacucggcgggagauucuguccuggugaaguuccacucggaugacaccaucaccaaaaaagguuuccaccuccgauacaccagcaccaaguuccaggacacacuccacagcaggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6119 - RNA, 1538 nt, Artificial Sequence
  mRNA product Design3 comprising derived and/or modified sequence from Homo sapiens__NP_001191.1__HsBMP2 (wt)
gggagagucccgcagucggcguccagcggcucugcuuguucgugugugugucguugcaggccuuauucaagcuuaccaugguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcagaugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6120 - RNA, 1574 nt, Artificial Sequence
  mRNA product Design3 comprising derived and/or modified sequence from Homo sapiens__NP_001193.2__HsBMP4 (wt)
gggagagucccgcagucggcguccagcggcucugcuuguucgugugugugucguugcaggccuuauucaagcuuaccaugauuccugguaaccgaaugcugauggucguuuuauuaugccaaguccugcuaggaggcgcgagccaugcuaguuugauaccugagacggggaagaaaaaagucgccgagauucagggccacgcgggaggacgccgcucagggcagagccaugagcuccugcgggacuucgaggcgacacuucugcagauguuugggcugcgccgccgcccgcagccuagcaagagugccgucauuccggacuacaugcgggaucuuuaccggcuucagucuggggaggaggaggaagaacagauccacagcacuggucuugaguauccugagcgcccggccagccgggccaacaccgugaggagcuuccaccacgaagaacaucuggagaacaucccagggaccagugaaaacucugcuuuucguuuccucuuuaaccucagcagcaucccugagaacgaggugaucuccucugcagagcuucggcuguuccgggagcaggucgaccagggcccugauugggaaaggggcuuccaccguauaaacauuuaugagguuaugaagcccccagcagaaguggugccugggcaccucaucacacgacuacuggacacgagacugguccaccacaaugugacacggugggaaacuuuugaugugagcccugcgguccuucgcuggacccgggagaagcagccaaacuaugggcuagccauugaggugacucaccuccaucagacucggacccaccagggccagcaugucaggauuagccgaucguuaccucaagggagugggaauugggcccagcuccggccccuccuggucaccuuuggccaugauggccggggccaugccuugacccgacgccggagggccaagcguagcccuaagcaucacucacagcgggccaggaagaagaauaagaacugccggcgccacucgcucuauguggacuucagcgaugugggcuggaaugacuggauuguggccccaccaggcuaccaggccuucuacugccauggggacugccccuuuccacuggcugaccaccucaacucaaccaaccaugccauugugcagacccuggucaauucugucaauuccaguauccccaaagccuguugugugcccacugaacugagugccaucuccaugcuguaccuggaugaguaugauaaggugguacugaaaaauuaucaggagaugguaguagagggaugugggugccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6121 - RNA, 1889 nt, Artificial Sequence
  mRNA product Design3 comprising derived and/or modified sequence from Homo sapiens__NP_001709.1__HsBMP6 (wt)
gggagagucccgcagucggcguccagcggcucugcuuguucgugugugugucguugcaggccuuauucaagcuuaccaugccggggcuggggcggagggcgcaguggcugugcugguggugggggcugcugugcagcugcugcgggcccccgccgcugcggccgcccuugcccgcugccgcggccgccgccgccggggggcagcugcugggggacggcgggagccccggccgcacggagcagccgccgccgucgccgcaguccuccucgggcuuccuguaccggcggcucaagacgcaggagaagcgggagaugcagaaggagaucuugucggugcuggggcucccgcaccggccccggccccugcacggccuccaacagccgcagcccccggcgcuccggcagcaggaggagcagcagcagcagcagcagcugccucgcggagagcccccucccgggcgacugaaguccgcgccccucuucaugcuggaucuguacaacgcccuguccgccgacaacgacgaggacggggcgucggagggggagaggcagcaguccuggccccacgaagcagccagcucgucccagcgucggcagccgcccccgggcgccgcgcacccgcucaaccgcaagagccuucuggcccccggaucuggcagcggcggcgcguccccacugaccagcgcgcaggacagcgccuuccucaacgacgcggacauggucaugagcuuugugaaccugguggaguacgacaaggaguucuccccucgucagcgacaccacaaagaguucaaguucaacuuaucccagauuccugagggugagguggugacggcugcagaguuccgcaucuacaaggacuguguuauggggaguuuuaaaaaccaaacuuuucuuaucagcauuuaucaagucuuacaggagcaucagcacagagacucugaccuguuuuuguuggacacccguguaguaugggccucagaagaaggcuggcuggaauuugacaucacggccacuagcaaucuguggguugugacuccacagcauaacauggggcuucagcugagcguggugacaagggauggaguccacguccacccccgagccgcaggccuggugggcagagacggcccuuacgacaagcagcccuucaugguggcuuucuucaaagugagugaggugcacgugcgcaccaccaggucagccuccagccggcgccgacaacagagucguaaucgcucuacccagucccaggacguggcgcgggucuccagugcuucagauuacaacagcagugaauugaaaacagccugcaggaagcaugagcuguaugugaguuuccaagaccugggauggcaggacuggaucauugcacccaagggcuaugcugccaauuacugugauggagaaugcuccuucccacucaacgcacacaugaaugcaaccaaccacgcgauugugcagaccuugguucaccuuaugaaccccgaguauguccccaaaccgugcugugcgccaacuaagcuaaaugccaucucgguucuuuacuuugaugacaacuccaaugucauucugaaaaaauacaggaauaugguuguaagagcuuguggaugccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6122 - RNA, 1643 nt, Artificial Sequence
  mRNA product Design3 comprising derived and/or modified sequence from Homo sapiens__NP_001710.1__HsBMP7 (wt)
gggagagucccgcagucggcguccagcggcucugcuuguucgugugugugucguugcaggccuuauucaagcuuaccaugcacgugcgcucacugcgagcugcggcgccgcacagcuucguggcgcucugggcaccccuguuccugcugcgcuccgcccuggccgacuucagccuggacaacgaggugcacucgagcuucauccaccggcgccuccgcagccaggagcggcgggagaugcagcgcgagauccucuccauuuugggcuugccccaccgcccgcgcccgcaccuccagggcaagcacaacucggcacccauguucaugcuggaccuguacaacgccauggcgguggaggagggcggcgggcccggcggccagggcuucuccuaccccuacaaggccgucuucaguacccagggccccccucuggccagccugcaagauagccauuuccucaccgacgccgacauggucaugagcuucgucaaccucguggaacaugacaaggaguucuuccacccacgcuaccaccaucgagaguuccgguuugaucuuuccaagaucccagaaggggaagcugucacggcagccgaguuccggaucuacaaggacuacauccgggaacgcuucgacaaugagacguuccggaucagcguuuaucaggugcuccaggagcacuugggcagggaaucggaucucuuccugcucgacagccguacccucugggccucggaggagggcuggcugguguuugacaucacagccaccagcaaccacuggguggucaauccgcggcacaaccugggccugcagcucucgguggagacgcuggaugggcagagcaucaaccccaaguuggcgggccugauugggcggcacgggccccagaacaagcagcccuucaugguggcuuucuucaaggccacggagguccacuuccgcagcauccgguccacggggagcaaacagcgcagccagaaccgcuccaagacgcccaagaaccaggaagcccugcggauggccaacguggcagagaacagcagcagcgaccagaggcaggccuguaagaagcacgagcuguaugucagcuuccgagaccugggcuggcaggacuggaucaucgcgccugaaggcuacgccgccuacuacugugagggggagugugccuucccucugaacuccuacaugaacgccaccaaccacgccaucgugcagacgcugguccacuucaucaacccggaaacggugcccaagcccugcugugcgcccacgcagcucaaugccaucuccguccucuacuucgaugacagcuccaacgucauccugaagaaauacagaaacauggugguccgggccuguggcugccacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6123 - RNA, 647 nt, Artificial Sequence
  mRNA product Design3 comprising derived and/or modified sequence from Homo sapiens__NP_006264.2__HsCCL7 (wt)
gggagagucccgcagucggcguccagcggcucugcuuguucgugugugugucguugcaggccuuauucaagcuuaccaugaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6124 - RNA, 3971 nt, Artificial Sequence
  mRNA product Design3 comprising derived and/or modified sequence from Homo sapiens__NP_001954.2__HsEGF (wt)
gggagagucccgcagucggcguccagcggcucugcuuguucgugugugugucguugcaggccuuauucaagcuuaccaugcugcucacucuuaucauucuguugccaguaguuucaaaauuuaguuuuguuagucucucagcaccgcagcacuggagcuguccugaagguacucucgcaggaaauggcaauucuacuuguguggguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccugagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcaggaggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcggagcuuucauaugcccuccuaugggacacagacccuugaagggggugucgagaagccccauucucuccuaucagcuaacccauuauggcaacaaagggcccuggacccaccacaccaaauggagcugacucagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6125 - RNA, 857 nt, Artificial Sequence
  mRNA product Design3 comprising derived and/or modified sequence from Homo sapiens__NP_001423.1__HsEREG (wt)
gggagagucccgcagucggcguccagcggcucugcuuguucgugugugugucguugcaggccuuauucaagcuuaccaugaccgcggggaggaggauggagaugcucugugccggcagggucccugcgcugcugcucugccuggguuuccaucuucuacaggcaguccucaguacaacugugauuccaucauguaucccaggagaguccagugauaacugcacagcuuuaguucagacagaagacaauccacguguggcucaagugucaauaacaaaguguagcucugacaugaauggcuauuguuugcauggacagugcaucuaucugguggacaugagucaaaacuacugcagaugugaaguggguuauacugguguccgaugugaacacuucuuuuuaaccguccaccaaccuuuaagcaaagaauauguggcuuugaccgugauucuuauuauuuuguuucuuaucacagucgucgguuccacauauuauuucugcagaugguacagaaaucgaaaaaguaaagaaccaaagaaggaauaugagagaguuaccucaggggauccagaguugccgcaagucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6126 - RNA, 1214 nt, Artificial Sequence
  mRNA product Design3 comprising derived and/or modified sequence from Homo sapiens__NP_001997.5__HsFGF2 (wt)
gggagagucccgcagucggcguccagcggcucugcuuguucgugugugugucguugcaggccuuauucaagcuuaccauggugggugugggggguggagauguagaagaugugacgccgcggcccggcgggugccagauuagcggacgcggugcccgcgguugcaacgggaucccgggcgcugcagcuugggaggcggcucuccccaggcggcguccgcggagacacccauccgugaaccccaggucccgggccgccggcucgccgcgcaccaggggccggcggacagaagaacggccgagcggcucgaggcugggggaccgcgggcgcggccgcgcgcugccgggcgggaggcuggggggccggggccggggccgugccccggagcgggucggaggccggggccggggccgggggacggcggcuccccgcgcggcuccagcggcucggggaucccggccgggccccgcagggaccauggcagccgggagcaucaccacgcugcccgccuugcccgaggauggcggcagcggcgccuucccgcccggccacuucaaggaccccaagcggcuguacugcaaaaacgggggcuucuuccugcgcauccaccccgacggccgaguugacgggguccgggaaaagagcgacccucacaucaagcuacaacuucaagcagaagagagaggaguugugucuaucaaaggagugugugcuaaccguuaccuggcuaugaaggaagauggaagauuacuggcuucuaaauguguuacggaugaguguuucuuuuuugaacgauuggaaucuaauaacuacaauacuuaccggucaaggaaauacaccaguugguauguggcacugaaacgaacugggcaguauaaacuuggauccaaaacaggaccugggcagaaagcuauacuuuuucuuccaaugucugcuaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6127 - RNA, 932 nt, Artificial Sequence
  mRNA product Design3 comprising derived and/or modified sequence from Homo sapiens__NP_002000.1__HsFGF7 (wt)
gggagagucccgcagucggcguccagcggcucugcuuguucgugugugugucguugcaggccuuauucaagcuuaccaugcacaaauggauacugacauggauccugccaacuuugcucuacagaucaugcuuucacauuaucugucuaguggguacuauaucuuuagcuugcaaugacaugacuccagagcaaauggcuacaaaugugaacuguuccagcccugagcgacacacaagaaguuaugauuacauggaaggaggggauauaagagugagaagacucuucugucgaacacagugguaccugaggaucgauaaaagaggcaaaguaaaagggacccaagagaugaagaauaauuacaauaucauggaaaucaggacaguggcaguuggaauuguggcaaucaaagggguggaaagugaguucuaucuugcaaugaacaaggaaggaaaacucuaugcaaagaaagaaugcaaugaagauuguaacuucaaagaacuaauucuggaaaaccauuacaacacauaugcaucagcuaaauggacacacaacggaggggaaauguuuguugccuuaaaucaaaaggggauuccuguaagaggaaaaaaaacgaagaaagaacaaaaaacagcccacuuucuuccuauggcaauaacuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6128 - RNA, 2534 nt, Artificial Sequence
  mRNA product Design3 comprising derived and/or modified sequence from Homo sapiens__NP_000592.3__HsHGF (wt)
gggagagucccgcagucggcguccagcggcucugcuuguucgugugugugucguugcaggccuuauucaagcuuaccaugugggugaccaaacuccugccagcccugcugcugcagcauguccuccugcaucuccuccugcuccccaucgccauccccuaugcagagggacaaaggaaaagaagaaauacaauucaugaguucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaaucccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcauggcuuggaauccaugauguccacggaagaggagaugagaaaugcaaacagguucucaauguuucccagcugguauauggcccugaaggaucagaucugguuuuaaugaagcuggccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6129 - RNA, 2273 nt, Artificial Sequence
  mRNA product Design3 comprising derived and/or modified sequence from Homo sapiens__NP_005336.3 __HsHSPA1A (wt)
gggagagucccgcagucggcguccagcggcucugcuuguucgugugugugucguugcaggccuuauucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggucagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaaaagcgccguggaggaugaggggcucaagggcaagaucagcgaggcggacaagaagaaggugcuggacaagugucaagaggucaucucguggcuggacgccaacaccuuggccgagaaggacgaguuugagcacaagaggaaggagcuggagcaggucuguaaccccaucaucagcggacuguaccagggugccgguggucccgggccugggggcuucggggcucagggucccaagggagggucugggucaggccccaccauugaggagguagauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6130 - RNA, 2273 nt, Artificial Sequence
  mRNA product Design3 comprising derived and/or modified sequence from Homo sapiens__NP_005337.2 __HsHSPA1B (wt)
gggagagucccgcagucggcguccagcggcucugcuuguucgugugugugucguugcaggccuuauucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggucagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaaaagcgccguggaggaugaggggcucaagggcaagaucagcgaggcggacaagaagaagguucuggacaagugucaagaggucaucucguggcuggacgccaacaccuuggccgagaaggacgaguuugagcacaagaggaaggagcuggagcaggucuguaaccccaucaucagcggacuguaccagggugccgguggucccgggccuggcggcuucggggcucagggucccaagggagggucugggucaggcccuaccauugaggagguggauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6131 - RNA, 2273 nt, Artificial Sequence
  mRNA product Design3 comprising derived and/or modified sequence from Homo sapiens__NP_005518.3 __HsHSPA1L (wt)
gggagagucccgcagucggcguccagcggcucugcuuguucgugugugugucguugcaggccuuauucaagcuuaccauggcuacugccaagggaaucgccauaggcaucgaccugggcaccaccuacuccuguguggggguguuccagcacggcaagguggagaucaucgccaacgaccagggcaaccgcaccacccccagcuacguggccuucacagacaccgagcggcucauuggggaugcggccaagaaccagguagcaaugaauccccagaacacuguuuuugaugcuaaacgucugaucggcaggaaauuuaaugauccuguuguacaagcagauaugaaacuuuggccuuuucaagugauuaaugaaggaggcaagcccaaaguccuuguguccuacaaaggggagaauaaagcauucuacccugaggaaaucucuucgaugguauugacuaaguugaaggagacugcugaggccuuuuugggccacccugucaccaaugcagugauuaccgugccagccuauuucaaugacucucaacgucaggcuacuaaggaugcaggagugauugcuggacuuaaugugcuaagaaucaucaaugagcccacggcugcugccauugccuaugguuuagauaaaggaggucaaggagaacgacauguccugauuuuugaucuggguggaggcacauuugaugugucaauucugaccauagaugaugggauuuuugagguaaaggccacugcuggggacacucaccuggguggggaggacuuugacaacaggcuugugagccacuucguggaggaguucaagaggaaacacaaaaaggacaucagccagaacaagcgagccgugaggcggcugcgcaccgccugcgagagggccaagaggacccugucguccagcacccaggccaaccuagaaauugauucacuuuaugaaggcauugacuucuauacauccaucaccagagcucgauuugaagaguugugugcagaccuguuuagggguacccuggagccuguagaaaaagcgcuucgggaugccaagauggauaaggcuaaaauccaugacauuguuuuaguagggggcuccacccgcauccccaaggugcagcggcugcuucaggacuacuucaauggacgugaucucaacaagagcaucaacccugaugaggccguagcauauggggcugcgguacaagcagccauccugaugggggacaagucugagaagguacaggaccugcugcugcuggacguggcuccccugucccuggggcuggagacggcugggggcgugaugacugcccugauaaagcgcaacuccaccauccccaccaagcagacacagauuuucaccaccuacucugacaaccaacccggggugcugauccagguguaugagggcgagagggccaugacaaaggacaacaaccugcuggggcgguuugaccugacuggaaucccuccagcacccaggggaguuccucagaucgaggugacguuugacauugaugccaaugguauucucaaugucacagccacggacaagagcaccggcaaggugaacaagaucaccaucaccaaugacaagggccgccugagcaaggaggagauugagcgcaugguucuggaugcugagaaauauaaagcugaagaugagguccagagggagaaaauugcugcaaagaaugccuuagaauccuaugcuuuuaacaugaagaguguugugagugaugaagguuugaagggcaagauuagugagucugauaaaaauaaaauauuggauaaaugcaacgagcuccuuucguggcuggaggucaaucaacuggcagagaaagaugaguuugaucauaagagaaaggaauuggagcagauguguaacccuaucaucacaaaacucuaccaaggaggaugcacugggccugccugcggaacaggguaugugccuggaaggccugccacaggccccacaauugaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6132 - RNA, 2870 nt, Artificial Sequence
  mRNA product Design3 comprising derived and/or modified sequence from Homo sapiens__NP_002145.3 __HsHSPA4 (wt)
gggagagucccgcagucggcguccagcggcucugcuuguucgugugugugucguugcaggccuuauucaagcuuaccaugucgguggugggcauagaccugggcuuccagagcugcuacgucgcuguggcccgcgccggcggcaucgagacuaucgcuaaugaguauagcgaccgcugcacgccggcuugcauuucuuuugguccuaagaaucguucaauuggagcagcagcuaaaagccagguaauuucuaaugcaaagaacacaguccaaggauuuaaaagauuccauggccgagcauucucugauccauuuguggaggcagaaaaaucuaaccuugcauaugauauugugcaguugccuacaggauuaacagguauaaaggugacauauauggaggaagaacgaaauuuuaccacugagcaagugacugccaugcuuuuguccaaacugaaggagacagccgaaaguguucuuaagaagccuguaguugacuguguuguuucgguuccuuguuucuauacugaugcagaaagacgaucagugauggaugcaacacagauugcuggucuuaauugcuugcgauuaaugaaugaaaccacugcaguugcucuugcauauggaaucuauaagcaggaucuuccugccuuagaagagaaaccaagaaauguaguuuuuguagacaugggccacucugcuuaucaaguuucuguaugugcauuuaauagaggaaaacugaaaguucuggccacugcauuugacacgacauugggagguagaaaauuugaugaaguguuaguaaaucacuucugugaagaauuugggaagaaauacaagcuagacauuaaguccaaaauccgugcauuauuacgacucucucaggagugugagaaacucaagaaauugaugagugcaaaugcuucagaucucccuuugagcauugaauguuuuaugaaugauguugauguaucuggaacuaugaauagaggcaaauuucuggagaugugcaaugaucucuuagcuagaguggagccaccacuucguaguguuuuggaacaaaccaaguuaaagaaagaagauauuuaugcaguggagauaguugguggugcuacacgaaucccugcgguaaaagagaagaucagcaaauuuuucgguaaagaacuuaguacaacauuaaaugcugaugaagcugucacucgaggcugugcauugcagugugccaucuuaucgccugcuuucaaagucagagaauuuucuaucacugauguaguaccauauccaauaucucugagauggaacucuccagcugaagaagggucaagugacugugaagucuuuuccaaaaaucaugcugcuccuuucucuaaaguucuuacauuuuauagaaaggaaccuuucacucuugaggccuacuacagcucuccucaggauuugcccuauccagauccugcuauagcucaguuuucaguucagaaagucacuccucagucugauggcuccaguucaaaagugaaagucaaaguucgaguaaauguccauggcauuuucaguguguccagugcaucuuuaguggagguucacaagucugaggaaaaugaggagccaauggaaacagaucagaaugcaaaggaggaagagaagaugcaaguggaccaggaggaaccacauguugaagaacaacagcagcagacaccagcagaaaauaaggcagagucugaagaaauggagaccucucaagcuggauccaaggauaaaaagauggaccaaccaccccaagccaagaaggcaaaagugaagaccaguacuguggaccugccaaucgagaaucagcuauuauggcagauagacagagagaugcucaacuuguacauugaaaaugaggguaagaugaucaugcaggauaaacuggagaaggagcggaaugaugcuaagaacgcaguggaggaauauguguaugaaaugagagacaagcugaguggugaauaugagaaguuugugagugaagaugaucguaacaguuuuacuuugaaacuggaagauacugaaaauugguuguaugaggauggagaagaccagccaaagcaaguuuauguugauaaguuggcugaauuaaaaaaucuaggucaaccuauuaagauacguuuccaggaaucugaagaacgaccaaaauuauuugaagaacuagggaaacagauccaacaguauaugaaaauaaucagcucuuucaaaaacaaggaggaccaguaugaucauuuggaugcugcugacaugacaaagguagaaaaaagcacaaaugaagcaauggaguggaugaauaacaagcuaaaucugcagaacaagcagaguuugaccauggauccaguugucaagucaaaagagauugaagcuaaaauuaaggagcugacaaguacuuguagcccuauaauuucaaagcccaaacccaaaguggaaccuccaaaagaggaacaaaaaaaugcagagcagaauggaccaguggauggacaaggagacaacccaggcccccaggcugcugagcaggguacagacacagcugugccuucggauucagacaagaagcugccugaaauggacauugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6133 - RNA, 2867 nt, Artificial Sequence
  mRNA product Design3 comprising derived and/or modified sequence from Homo sapiens__NP_055093.2 __HsHSPA4L (wt)
gggagagucccgcagucggcguccagcggcucugcuuguucgugugugugucguugcaggccuuauucaagcuuaccaugucugugguuggcauugaccucggcuuucucaacugcuacauugcugucgcgagaaguggcggcaucgagaccaucgccaaugaguacagcgacagguguaccccggccuguauaucauugggaucaagaacucgagccauuggaaaugcagcaaagagccagauagucacgaacguaagaaauacaauucauggcuucaaaaagcugcaugggcgaucauuugaugaucccauugugcaaacugaaaggaucaggcuucccuaugaacugcagaaaaugccuaauggaagugcaggaguuaaggugcgguacuuagaggaagagagaccuuuugcaauugagcaaguuacuggaaugcuguuagccaagcugaaagagacuucagaaaaugcuuugaagaaaccaguggcugacugugugauuucaauuccuagcuuuuuuacugaugccgagagaagaucugugauggcugcagcccagguugcaggcuuaaauuguuuaagguugaugaaugaaacuacugcaguugcacuggcguauggaauuuauaaacaggaucuucccccauuagaugagaaaccaagaaauguaguauuuauugauaugggacauucugccuaucaggucuugguuugugcuuuuaacaaaggaaaacuuaaagucuuggcuacuaccuuugauccauauuuggguggcaggaacuuugaugaggcuuuaguagacuacuucugugaugaguucaagaccaaauauaagauaaaugugaaagaaaacucucgggccuuguugcguuuauaucaggaaugugaaaaacuaaagaagcuaaugagugcaaaugcaucagaucuuccauugaacauugaguguuucaugaaugaccuugauguuucuaguaaaaugaacagggcucaauuugaacaacugugugcuucccuuuuggccaggguugaaccaccuuuaaaagcaguaauggaacaagcuaacuuacaacgugaagacauuaguaguauagaaauuguaggaggagcaacacgaaucccugcagugaaagaacaaaucacuaaauucuuucuuaaagacauaaguaccacauuaaaugcugaugaagcuguugcaagaggaugugcguuacagugugcgauucucucaccagcauuuaaagugcgugaauuuuccauaacagaccuuguucccuauucaaucacauuaagguggaagaccucuuuugaagauggaaguggggaaugugaaguuuucuguaagaaccauccugccccauucucaaaagucauuacuuuccacaagaaggaaccauuugaacuagaagcauuuuauacuaauuuacaugaagugccuuauccugaugcaagaauugggagcuucacuauucagaauguuuuuccacagucugauggugauaguuccaaagugaagguuaaaguucguguuaacauccauggaaucuucaguguggcuagcgcaucaguaauugagaagcaaaauuuggaaggcgaucacagugaugcuccaauggagacagaaacuucauuuaaaaaugaaaacaaagauaauauggauaaaaugcagguugaucaagaagaagggcaucaaaaaugucaugcugaacacacuccagaagaggaaauugaucauacaggagccaaaacaaagucagcugucucagacaaacaagaccgauuaaaucagacacuuaaaaaaggaaaagucaaaaguauugaucuaccgauccagaguagccuauguagacaacuaggccaagaucuucucaacagcuacauugaaaaugaggggaagaugaucaugcaagauaaguuagagaaagaaagaaaugaugcuaagaaugccguugaagaauauguauaugauuuuagagacaggcugggcacugucuaugaaaaauucaucacuccagaagacuugaguaaacugucugcaguauuggaagacacagaaaauuggcuuuaugaagacggagaggaccaaccuaaacaaguuuauguggauaagcugcaagaacuaaagaaauacggccagccuauucaaaugaaguacauggagcaugaagagagaccaaaagccuuaaaugacuugggaaaaaagauccaacuugucaugaaagugauagaagcauauagaaacaaggaugaaagauaugaucaucuggauccuacugaaauggaaaagguugaaaaauguaucagugaugccaugaguuggcugaauaguaagaugaaugcacagaacaaacuaagucucacucaagauccugugguaaaaguuucagaaauaguagcaaagucaaaggaacuggauaauuucuguaaccccaucauuuacaagcccaaaccaaaagcagaaguuccugaagacaaaccaaaagcuaauagugaacacaauggcccaauggauggacagaguggaacugaaacuaaaucagauucaacaaaagacagcucacagcauacuaaauccucuggagagauggaaguggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6134 - RNA, 2312 nt, Artificial Sequence
  mRNA product Design3 comprising derived and/or modified sequence from Homo sapiens__NP_005338.1__HsHSPA5 (wt)
gggagagucccgcagucggcguccagcggcucugcuuguucgugugugugucguugcaggccuuauucaagcuuaccaugaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagaacucaacauggaucuguuccggucuacuaugaagcccguccagaaaguguuggaagauucugauuugaagaagucugauauugaugaaauuguucuuguugguggcucgacucgaaucccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaaucccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6135 - RNA, 2279 nt, Artificial Sequence
  mRNA product Design3 comprising derived and/or modified sequence from Homo sapiens__NP_002146.2__HsHSPA6 (wt)
gggagagucccgcagucggcguccagcggcucugcuuguucgugugugugucguugcaggccuuauucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccggguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccgccuauuucaaugacucgcagcgccaggccaccaaggacgcgggggccaucgcggggcucaacguguugcggaucaucaaugagcccacggcagcugccaucgccuaugggcuggaccggcggggcgcgggagagcgcaacgugcucauuuuugaccugggugggggcaccuucgaugugucgguucucuccauugacgcuggugucuuugaggugaaagccacugcuggagauacccaccugggaggagaggacuucgacaaccggcucgugaaccacuucauggaagaguuccggcggaagcaugggaaggaccugagcgggaacaagcgugcccugcgcaggcugcgcacagccugugagcgcgccaagcgcacccuguccuccagcacccaggccacccuggagauagacucccuguucgagggcguggacuucuacacguccaucacucgugcccgcuuugaggaacugugcucagaccucuuccgcagcacccuggagccgguggagaaggcccugcgggaugccaagcuggacaaggcccagauucaugacgucguccugguggggggcuccacacgcauccccaaggugcagaaguugcugcaggacuucuucaacggcaaggagcugaacaagagcaucaacccugaugaggcuguggccuauggggcugcugugcaggcggccguguugaugggggacaaaugugagaaagugcaggaucuccugcugcuggauguggcuccccugucucuggggcuggagacagcaggaggggugaugaccacgcugauccagaggaacgccacuauccccaccaagcagacccagacuuucaccaccuacucggacaaccagccuggggucuucauccagguguaugagggugagagggccaugaccaaggacaacaaccugcuggggcguuuugaacucaguggcaucccuccugccccacguggagucccccagauagaggugacuuuugacauugaugcuaauggcauccugagcgugacagccacugacaggagcacagguaaggcuaacaagaucaccaucaccaaugacaagggccggcugagcaaggaggagguggagaggaugguucaugaagccgagcaguacaaggcugaggaugaggcccagagggacagaguggcugccaaaaacucgcuggaggcccaugucuuccaugugaaagguucuuugcaagaggaaagccuuagggacaagauucccgaagaggacaggcgcaaaaugcaagacaagugucgggaaguccuugccuggcuggagcacaaccagcuggcagagaaggaggaguaugagcaucagaagagggagcuggagcaaaucugucgccccaucuucuccaggcucuauggggggccuggugucccugggggcagcaguuguggcacucaagcccgccagggggaccccagcaccggccccaucauugaggagguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6136 - RNA, 1451 nt, Artificial Sequence
  mRNA product Design3 comprising derived and/or modified sequence from Homo sapiens__P48741__HsHSPA7 (wt)
gggagagucccgcagucggcguccagcggcucugcuuguucgugugugugucguugcaggccuuauucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccagguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccaccuauuucaguaacucgcagcgccaggccaccaaggacgcgggggccaucgcggggcucaaggugcugccgaucaucaaugaggccacggcagcagccaucgccuaugggcuggaccggcggggcgcgggaaagcgcaacgugcucauuuuugaccugggugggggcaccuucgaugugucgguucucuccauugacgccggugucuuugaggugaaagccacugcuggagauacccaccugggaggagaggacuucgacaaccggcucgugaaccacuucauggaagaguuccggcggaagcaugggaaggaccugagcgggaacaagcgugcccugcgcaggcugcgcacagccugugagcgcgccaagcgcaccccguccuccagcacccaggccacccuggagauagacucccuguucgagggcguggacuucuacaaguccaucacucgugcccgcuuugaggaacugugcucagaccucuuccgcagcacccuggagccgguggagaaggcccugcgggaugccaagcuggacaaggcccagauucaugacuucguccuggggggagggcuccacucgcauccccaaggugcagaaguugcugcaggacuucuucaacggcaaggagcugaacaagagcaucaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6137 - RNA, 2288 nt, Artificial Sequence
  mRNA product Design3 comprising derived and/or modified sequence from Homo sapiens__NP_006588.1 __HsHSPA8 (wt)
gggagagucccgcagucggcguccagcggcucugcuuguucgugugugugucguugcaggccuuauucaagcuuaccauguccaagggaccugcaguugguauugaucuuggcaccaccuacucuuguguggguguuuuccagcacggaaaagucgagauaauugccaaugaucagggaaaccgaaccacuccaagcuaugucgccuuuacggacacugaacgguugaucggugaugccgcaaagaaucaaguugcaaugaaccccaccaacacaguuuuugaugccaaacgucugauuggacgcagauuugaugaugcuguuguccagucugauaugaaacauuggcccuuuaugguggugaaugaugcuggcaggcccaagguccaaguagaauacaagggagagaccaagagcuucuauccagaggaggugucuucuaugguucugacaaagaugaaggaaauugcagaagccuaccuugggaagacuguuaccaaugcuguggucacagugccagcuuacuuuaaugacucucagcgucaggcuaccaaagaugcuggaacuauugcuggucucaauguacuuagaauuauuaaugagccaacugcugcugcuauugcuuacggcuuagacaaaaagguuggagcagaaagaaacgugcucaucuuugaccugggagguggcacuuuugaugugucaauccucacuauugaggauggaaucuuugaggucaagucuacagcuggagacacccacuuggguggagaagauuuugacaaccgaauggucaaccauuuuauugcugaguuuaagcgcaagcauaagaaggacaucagugagaacaagagagcuguaagacgccuccguacugcuugugaacgugcuaagcguacccucucuuccagcacccaggccaguauugagaucgauucucucuaugaaggaaucgacuucuauaccuccauuacccgugcccgauuugaagaacugaaugcugaccuguuccguggcacccuggacccaguagagaaagcccuucgagaugccaaacuagacaagucacagauucaugauauuguccugguuggugguucuacucguauccccaagauucagaagcugcuccaagacuucuucaauggaaaagaacugaauaagagcaucaacccugaugaagcuguugcuuauggugcagcuguccaggcagccaucuugucuggagacaagucugagaauguucaagauuugcugcucuuggaugucacuccucuuucccuugguauugaaacugcugguggagucaugacuguccucaucaagcguaauaccaccauuccuaccaagcagacacagaccuucacuaccuauucugacaaccagccuggugugcuuauucagguuuaugaaggcgagcgugccaugacaaaggauaacaaccugcuuggcaaguuugaacucacaggcauaccuccugcaccccgagguguuccucagauugaagucacuuuugacauugaugccaaugguauacucaaugucucugcuguggacaagaguacgggaaaagagaacaagauuacuaucacuaaugacaagggccguuugagcaaggaagacauugaacguaugguccaggaagcugagaaguacaaagcugaagaugagaagcagagggacaaggugucauccaagaacucacuugaguccuaugccuucaacaugaaagcaacuguugaagaugagaaacuucaaggcaagauuaacgaugaggacaaacagaagauucuggacaaguguaaugaaauuaucaacuggcuugauaagaaucagacugcugagaaggaagaauuugaacaucaacagaaagagcuggagaaaguuugcaaccccaucaucaccaagcuguaccagagugcaggaggcaugccaggaggaaugccugggggauuuccuggugguggagcuccucccucugguggugcuuccucagggcccaccauugaagagguugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6138 - RNA, 2387 nt, Artificial Sequence
  mRNA product Design3 comprising derived and/or modified sequence from Homo sapiens__NP_004125.3 __HsHSPA9 (wt)
gggagagucccgcagucggcguccagcggcucugcuuguucgugugugugucguugcaggccuuauucaagcuuaccaugauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaaaagccagguauucucuacugccgcugauggucaaacgcaaguggaaauuaaagugugucagggugaaagagagauggcuggagacaacaaacuccuuggacaguuuacuuugauuggaaucccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaguucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucacugaagcuguucgaaauggcauacaaaaagauggcaucugagcgagaaggcucuggaaguucuggcacuggggaacaaaaggaagaucaaaaggaggaaaaacaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6139 - RNA, 2408 nt, Artificial Sequence
  mRNA product Design3 comprising derived and/or modified sequence from Homo sapiens__NP_443202.3 __HsHSPA12B (wt)
gggagagucccgcagucggcguccagcggcucugcuuguucgugugugugucguugcaggccuuauucaagcuuaccauguuggcugucccggagaugggccugcaggggcuguacaucggcuccagcccggagcgguccccagugccuagcccacccggcuccccgaggacccaggaaagcugcggcauugccccccucacacccucgcagucuccaaaacccgagguccgagccccccagcaggccuccuucucuguggugguggccauugacuucggcaccacgucuaguggcuaugcuuucagcuuugccagugacccugaggccauccacaugaugaggaaaugggagggcggagacccgggcguggcccaccagaagaccccgaccugccugcugcugacuccggagggcgccuuccacagcuuuggcuacaccgcccgcgauuacuaccaugaccuggaccccgaagaggcgcgggacuggcucuacuucgagaaguucaagaugaagauccacagcgccacggaucucaccuugaagacccagcuagaggcaguaaauggaaagacgaugcccgcccuggagguguucgcccaugcccugcgcuucuucagggagcacgcccuucaggagcugagggagcagagcccaucgcugccagagaaggacacugugcgcuggguguugacggugccugccaucuggaaacagccagccaagcaguucaugcgggaggcugccuaccuggcuggacuugugucccgagagaaugcagagcagcuacucaucgcccuggagcccgaggccgccucgguauacugccgcaagcugcgccugcaccagcuccuggaccugaguggccgggccccagguggugggcgccugggugagcgccgcuccaucgacuccagcuuccgucaggcucgggagcagcugcgaaggucccgccacagccgcacguuccugguggagucaggcguaggagagcugugggcagagaugcaagcaggagaccgcuacgugguggccgacugcggcggaggcaccguggaccugacggugcaccagcuggagcagccccauggcacccucaaggagcucuacaaggcaucugggggcccuuauggcgcggugggcguggaccuggccuucgagcagcugcugugccgcaucuucggcgaggacuucaucgccaccuucaaaaggcaacggccggcagccuggguagaucugaccaucgccuucgaggcucgcaagcgcacugcuggcccacaccgugcaggggcgcucaacaucucgcugcccuucuccuucauugacuucuaccgcaagcagcggggccacaacguggagaccgcucugcgcaggagcagcgugaacuucgugaagugguccucacaggggaugcuccgaaugucuugugaagccaugaacgagcucuuucagcccaccgucagcgggaucauccagcacauagaggcccugcuggcacggccggaggugcagggugugaagcugcuguuccuagugggcggcuucgccgagucagcggugcugcagcacgcggugcaggcggcgcugggcgcccgcggucugcgugucguggucccgcacgacgugggccucaccauccucaaaggcgcggugcuguucggccaggcgccgggcguggugcggguccgccgcucgccgcucaccuauggcgugggcgugcucaaccgcuuugugccugggcgccacccgcccgaaaagcugcugguucgcgacggccgccgcuggugcaccgacgucuucgagcgcuucguggccgccgagcagucgguggcccugggcgaggaggugcggcgcagcuacugcccggcgcgucccggccagcggcgcguacucaucaaccuguacugcugcgcggcagaggaugcgcgcuucaucaccgaccccggcgugcgcaaaugcggcgcgcucagccucgagcuugagcccgccgacugcggccaggacaccgccggcgcgccucccggccgccgcgagauccgcgccgccaugcaguuuggcgacaccgaaauuaaggucaccgccgucgacgucagcaccaaucgcuccgugcgcgcguccaucgacuuucuuuccaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6140 - RNA, 1877 nt, Artificial Sequence
  mRNA product Design3 comprising derived and/or modified sequence from Homo sapiens__NP_057383.2__HsHSPA14 (wt)
gggagagucccgcagucggcguccagcggcucugcuuguucgugugugugucguugcaggccuuauucaagcuuaccauggcggccaucggaguucaccugggcugcaccucagccuguguggccgucuauaaggauggccgggcuggugugguugcaaaugaugccggugaccgaguuacuccagcuguuguugcuuacucagaaaaugaagagauuguuggauuggcagcaaaacaaaguagaauaagaaauauuucaaauacaguaaugaaaguaaagcagauccugggcagaagcuccagugauccacaagcucagaaauacaucgcggaaaguaaauguuuagucauugaaaaaaaugggaaauuacgauaugaaauagauacuggagaagaaacaaaauuuguuaacccagaagauguugccagacugauauuuaguaaaaugaaagaaacggcacauucuguauugggcucagaugcaaaugauguaguuauuacugucccguuugauuuuggagaaaagcaaaaaaaugcucuuggagaagcagcuagagcugcuggauuuaauguuuugcgauuaauucacgaaccgucugcagcucugcuugcuuauggaauuggacaagacuccccuacuggaaaaagcaauauuuugguguuuaagcugggaggaacauccuuaucucucagcgucauggaaguuaacaguggaauauaucggguucuuucaacaaacacugaugauaacaucgguggugcacauuucacagaaaccuuagcacaguaucuagcuucugaguuccaaagauccuucaaacaugaugugagaggaaaugcgcgagccaugaugaaauuaacgaacagugcugaaguagcgaaacauucuuugucaaccuugggaagugccaacuguuuucuugacucauuauaugaaggucaagauuuugauugcaauguguccagagcaagauuugaacuucuuuguucuccacuuuuuaauaaguguauagaagcaaucagaggacucuuagaucaaaauggauuuacagcagaugauaucaacaagguuguccuuuguggagggucuucucgaaucccaaagcuacagcaacugauuaaagaucuuuucccagcuguugagcuucucaauucuaucccuccugaugaagugaucccuauuggugcagcuauagaagcaggaauccuuauugggaaagaaaaccuguugguggaagacucucuuaugauagaguguucagccagagauauuuuaguuaaggguguggacgaaucaggagccaguagauucacagugcuguuuccaucagggacuccuuugccagcucgaagacaacacacauugcaagccccuggaagcauaucuucagugugccuugaacucuaugagucugaugggaagaacucugccaaagaggaaaccaaguuugcacagguuguacuccaggauuuagauaaaaaagaaaauggauuacgugauauauuagcuguucuuacuaugaaaagggauggaucuuuacaugugacaugcacagaucaagaaacuggaaaaugugaagcaaucucuauugagauagcaucuuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6141 - RNA, 2924 nt, Artificial Sequence
  mRNA product Design3 comprising derived and/or modified sequence from Homo sapiens__NP_006635.2 __HsHSPH1 (wt)
gggagagucccgcagucggcguccagcggcucugcuuguucgugugugugucguugcaggccuuauucaagcuuaccaugucgguggugggguuggacgugggcucgcagagcugcuacaucgcgguagcccgggccgggggcaucgagaccaucgccaaugaguucagcgaccggugcaccccgucagucauaucauuuggaucaaaaaauagaacaaucggaguugcagccaaaaaucagcaaaucacucaugcaaacaauacggugucuaacuucaaaagauuucauggccgagcauucaaugaccccuucauucaaaaggagaaggaaaacuugaguuacgauuugguuccauugaaaaaugguggaguuggaauaaagguaauguacaugggugaagaacaucuauuuaguguggagcagauaacagccauguuguugacuaagcugaaggaaacugcugaaaacagccucaagaaaccaguaacagauuguguuauuucaguccccuccuucuuuacagaugcugagaggcgaucuguguuagaugcugcacagauuguuggccuaaacuguuuaagacuuaugaaugacaugacagcuguugcuuugaauuacggaauuuauaagcaggaucucccaagccuggaugagaaaccucggauagugguuuuuguugauaugggacauucagcuuuucaagugucugcuugugcuuuuaacaagggaaaauugaagguacugggaacagcuuuugauccuuucuuaggaggaaaaaacuucgaugaaaaguuaguggaacauuuuugugcagaauuuaaaacuaaguacaaguuggaugcaaaauccaaaauacgagcacuccuacgucuguaucaggaaugugaaaaacugaaaaagcuaaugagcucuaacagcacagaccuuccacugaauaucgaaugcuuuaugaaugauaaagauguuuccggaaagaugaacaggucacaauuugaagaacucugugcugaacuucugcaaaagauagaaguaccccuuuauucacuguuggaacaaacucaucucaaaguagaagaugugagugcaguugagauuguuggaggcgcuacacgaaucccagcugugaaggaaagaauugccaaauucuuuggaaaagauauuagcacaacacucaaugcagaugaagcaguagccagaggaugugcauuacagugugcaauacuuuccccggcauuuaaaguuagagaauuuuccgucacagaugcaguuccuuuuccaauaucucugaucuggaaccaugauucagaagauacugaagguguucaugaagucuuuagucgaaaccaugcugcuccuuucuccaaaguucucaccuuucugagaagggggccuuuugagcuagaagcauucuauucugauccccaaggaguuccauauccagaagcaaaaauaggccgcuuuguaguucagaauguuucugcacagaaagauggagaaaaaucuagaguaaaagucaaagugcgagucaacacccauggcauuuucaccaucucuacggcaucuaugguggagaaagucccaacugaggagaaugaaaugucuucugaagcugacauggagugucugaaucagagaccaccagaaaacccagacacugauaaaaauguccagcaagacaacagugaagcuggaacacagccccagguacaaacugaugcucaacaaaccucacagucucccccuucaccugaacuuaccucagaagaaaacaaaaucccagaugcugacaaagcaaaugaaaaaaaaguugaccagccuccagaagcuaaaaagcccaaaauaaagguggugaauguugagcugccuauugaagccaacuuggucuggcaguuagggaaagaccuucuuaacauguauauugagacagaggguaagaugauaaugcaagauaaauuggaaaaagaaaggaaugaugcuaaaaaugcaguugaggaauauguguaugaguucagagacaagcuguguggaccauaugaaaaauuuauaugugagcaggaucaucaaaauuuuuugagacuccucacagaaacugaagacuggcuguaugaagaaggagaggaccaagcuaaacaagcauauguugacaaguuggaagaauuaaugaaaauuggcacuccaguuaaaguucgguuucaggaagcugaagaacggccaaaaauguuugaagaacuaggacagaggcugcagcauuaugccaagauagcagcugacuucagaaauaaggaugagaaauacaaccauauugaugagucugaaaugaaaaaaguggagaagucuguuaaugaagugauggaauggaugaauaaugucaugaaugcucaggcuaaaaagagucuugaucaggauccaguuguacgugcucaggaaauuaaaacaaaaaucaaggaauugaacaacacaugugaacccguuguaacacaaccgaaaccaaaaauugaaucacccaaacuggaaagaacuccaaauggcccaaauauugauaaaaaggaagaagauuuagaagacaaaaacaauuuuggugcugaaccuccacaucagaauggugaauguuacccuaaugagaaaaauucuguuaauauggacuuggacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6142 - RNA, 3347 nt, Artificial Sequence
  mRNA product Design3 comprising derived and/or modified sequence from Homo sapiens__NP_006380.1 __HsHYOU1 (wt)
gggagagucccgcagucggcguccagcggcucugcuuguucgugugugugucguugcaggccuuauucaagcuuaccauggcagacaaaguuaggaggcagaggccgaggaggcgagucuguugggccuugguggcugugcucuuggcagaccuguuggcacugagugauacacuggcagugaugucuguggaccugggcagugaguccaugaagguggccauugucaaaccuggagugcccauggaaauugucuugaauaaggaaucucggaggaaaacaccggugaucgugacccugaaagaaaaugaaagauucuuuggagacagugcagcaagcauggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgcagcugcaguucucaccugaggaaguguugggcaugguucucaauuauucucguucucuagcugaagauuuugcagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccagaauaucauguucuaugacaugggcucaggcagcaccguaugcaccauugugaccuaccagauggugaagacuaaggaagcugggaugcagccacagcugcagauccggggaguaggauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacagauugaaggccugauggaugauguggacuucaaggcaaaagugacucguguggaauuugaggaguugugugcagacuuguuugagcgggugccugggccuguacagcaggcccuccagagugccgaaaugagucuggaugagauugagcaggucauccugguggguggggccacucggguccccagaguucaggaggugcugcugaaggccgugggcaaggaggagcuggggaagaacaucaaugcagaugaagcagccgccaugggggcaguguaccaggcagcugcgcucagcaaagccuuuaaagugaagccauuugucguccgagaugcaguggucuaccccauccugguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggguauuuggcucccagaaucugaccacagugaagcuaaaaggggugggugacagcuucaagaaguauccugacuacgaguccaagggcaucaaggcucacuucaaccuggaugagaguggcgugcucagucuagacaggguggagucuguauuugagacacugguagaggacagcgcagaagaggaaucuacucucaccaaacuuggcaacaccauuuccagccuguuuggaggcgguaccacaccagaugccaaggagaaugguacugauacuguccaggaggaagaggagagcccugcagaggggagcaaggacgagccuggggagcaggucgagcucaaggaggaagcugaggccccaguggaggauggcucucagcccccacccccugaaccuaagggagaugcaaccccugagggagaaaaggccacagaaaaagaaaauggggacaagucugaggcccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaacuucaggacuugacacuccgagaccuggagaagcaggaacgggaaaaagcugccaacagcuuggaagcauucauauuugagacccaggacaagcuguaccagcccgaguaccaggaaguguccacagaggagcagcgugaggagaucucugggaagcucagcgccgcauccaccuggcuggaggaugaggguguuggagccaccacagugauguugaaggagaagcuggcugagcugaggaagcugugccaagggcuguuuuuucggguagaggagcgcaagaaguggcccgaacggcugucugcccucgauaaucuccucaaccauuccagcauguuccucaagggggcccggcucaucccagagauggaccagaucuucacugagguggagaugacaacguuagagaaagucaucaaugagaccugggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggccagacugaagaugcagagcccauuucagaaccugagaaaguagagacuggauccgagccaggagacacugagccuuuggaguuaggagguccuggagcagaaccugaacagaaagaacaaucgacaggacagaagcggccuuugaagaacgacgaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6143 - RNA, 2546 nt, Artificial Sequence
  mRNA product Design3 comprising derived and/or modified sequence from Homo sapiens__NP_005339.3 __HsHSP90AA1 (wt)
gggagagucccgcagucggcguccagcggcucugcuuguucgugugugugucguugcaggccuuauucaagcuuaccaugccugaggaaacccagacccaagaccaaccgauggaggaggaggagguugagacguucgccuuucaggcagaaauugcccaguugaugucauugaucaucaauacuuucuacucgaacaaagagaucuuucugagagagcucauuucaaauucaucagaugcauuggacaaaauccgguaugagagcuugacagaucccaguaaauuagacucugggaaagagcugcauauuaaccuuauaccgaacaaacaagaucgaacucucacuauuguggauacuggaauuggaaugaccaaggcugacuugaucaauaaccuugguacuaucgccaagucugggaccaaagcguucauggaagcauugcaggcuggugcagauaucucuaugauuggccaguucgguguugguuuuuauucugcuuauuugguugcugagaaaguaacugugaucaccaaacauaacgaugaugagcaguacgcuugggaguccucagcagggggaucauucacagugaggacagacacaggugaaccuaugggucguggaacaaaaguuauccuacaccugaaagaagaccaaacugaguacuuggaggaacgaagaauaaaggagauugugaagaaacauucucaguuuauuggauaucccauuacucuuuuuguggagaaggaacgugauaaagaaguaagcgaugaugaggcugaagaaaaggaagacaaagaagaagaaaaagaaaaagaagagaaagagucggaagacaaaccugaaauugaagauguugguucugaugaggaagaagaaaagaaggauggugacaagaagaagaagaagaagauuaaggaaaaguacaucgaucaagaagaacucaacaaaacaaagcccaucuggaccagaaaucccgacgauauuacuaaugaggaguacggagaguucuauaagagcuugaccaaugacugggaagaucacuuggcagugaagcauuuuucaguugaaggacaguuggaguucagagcccuucuauuugucccacgacgugcuccuuuugaucuguuugaaaacagaaagaaaaagaacaacaucaaauuguauguacgcagaguuuucaucauggauaacugugaggagcuaaucccugaauaucugaacuucauuagaggggugguagacucggaggaucucccucuaaacauaucccgugagauguugcaacaaagcaaaauuuugaaaguuaucaggaagaauuuggucaaaaaaugcuuagaacucuuuacugaacuggcggaagauaaagagaacuacaagaaauucuaugagcaguucucuaaaaacauaaagcucggaauacacgaagacucucaaaaucggaagaagcucucagagcuguuaagguacuacacaucugccucuggugaugagaugguuucucucaaggacuacugcaccagaaugaaggagaaccagaaacauaucuauuauaucacaggugagaccaaggaccagguagcuaacucagccuuuguggaacgucuucggaaacauggcuuagaagugaucuauaugauugagcccauugaugaguacuguguccaacagcugaaggaauuugaggggaagacuuuagugucagucaccaaagaaggccuggaacuuccagaggaugaagaagagaaaaagaagcaggaagagaaaaaaacaaaguuugagaaccucugcaaaaucaugaaagacauauuggagaaaaaaguugaaaaggugguugugucaaaccgauuggugacaucuccaugcuguauugucacaagcacauauggcuggacagcaaacauggagagaaucaugaaagcucaagcccuaagagacaacucaacaauggguuacauggcagcaaagaaacaccuggagauaaacccugaccauuccauuauugagaccuuaaggcaaaaggcagaggcugauaagaacgacaagucugugaaggaucuggucaucuugcuuuaugaaacugcgcuccugucuucuggcuucagucuggaagauccccagacacaugcuaacaggaucuacaggaugaucaaacuuggucuggguauugaugaagaugacccuacugcugaugauaccagugcugcuguaacugaagaaaugccaccccuugaaggagaugacgacacaucacgcauggaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6144 - RNA, 686 nt, Artificial Sequence
  mRNA product Design3 comprising derived and/or modified sequence from Homo sapiens__NG_005218__HsHSP90AA3P (wt)
gggagagucccgcagucggcguccagcggcucugcuuguucgugugugugucguugcaggccuuauucaagcuuaccauggauuccaguaaauuagacucugggaaagggcugcauauuaaccuuguaccaaacaaacaaaaucaaacccucacuauuguggacacuagaauuggaaugaccaagacugacuugaucaauaaccucgguacugucaccaagucugggaccaaagcauucauggaagcauugcaggcugaugcagauaucucuaugauuggccauuucgggguugguuuuuauucugcuuauuugguugccaagaaaguaacugugaucagcaaacauaacaaugaugagcaguacaccugggaguccucagcagggggaucauucacagugaggacagacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6145 - RNA, 2522 nt, Artificial Sequence
  mRNA product Design3 comprising derived and/or modified sequence from Homo sapiens__NP_031381.2__HsHSP90AB1 (wt)
gggagagucccgcagucggcguccagcggcucugcuuguucgugugugugucguugcaggccuuauucaagcuuaccaugccugaggaagugcaccauggagaggaggagguggagacuuuugccuuucaggcagaaauugcccaacucaugucccucaucaucaauaccuucuauuccaacaaggagauuuuccuucgggaguugaucucuaaugcuucugaugccuuggacaagauucgcuaugagagccugacagacccuucgaaguuggacagugguaaagagcugaaaauugacaucauccccaacccucaggaacguacccugacuuugguagacacaggcauuggcaugaccaaagcugaucucauaaauaauuugggaaccauugccaagucugguacuaaagcauucauggaggcucugcaggcuggugcagacaucuccaugauugggcaguuugguguuggcuuuuauucugccuacuugguggcagagaaagugguugugaucacaaagcacaacgaugaugaacaguaugcuugggagucuucugcuggagguuccuucacugugcgugcugaccauggugagcccauuggcagggguaccaaagugauccuccaucuuaaagaagaucagacagaguaccuagaagagaggcgggucaaagaaguagugaagaagcauucucaguucauaggcuaucccaucacccuuuauuuggagaaggaacgagagaaggaaauuagugaugaugaggcagaggaagagaaaggugagaaagaagaggaagauaaagaugaugaagaaaaacccaagaucgaagauguggguucagaugaggaggaugacagcgguaaggauaagaagaagaaaacuaagaagaucaaagagaaauacauugaucaggaagaacuaaacaagaccaagccuauuuggaccagaaacccugaugacaucacccaagaggaguauggagaguucuacaagagccucacuaaugacugggaagaccacuuggcagucaagcacuuuucuguagaaggucaguuggaguucagggcauugcuauuuauuccucgucgggcucccuuugaccuuuuugagaacaagaagaaaaagaacaacaucaaacucuauguccgccguguguucaucauggacagcugugaugaguugauaccagaguaucucaauuuuauccguggugugguugacucugaggaucugccccugaacaucucccgagaaaugcuccagcagagcaaaaucuugaaagucauucgcaaaaacauuguuaagaagugccuugagcuguucucugagcuggcagaagacaaggagaauuacaagaaauucuaugaggcauucucuaaaaaucucaagcucggaauccacgaagacuccacuaaccgccgccgccugucugagcugcugcgcuaucauaccucccagucuggagaugagaugacaucucugucagaguauguuucucgcaugaaggagacacagaaguccaucuauuacaucacuggugagagcaaagagcaggucgccaacucagcuuuuguggagcgagugcggaaacggggcuucgaggugguauauaugaccgagcccauugacgaguacugugugcagcagcucaaggaauuugaugggaaaagccuggucucaguuaccaaggagggucuggagcugccugaggaugaggaggagaagaagaagauggaagagagcaaggcaaaguuugagaaccucugcaagcucaugaaagaaaucuuagauaagaagguugagaaggugacaaucuccaauagacuugugucuucaccuugcugcauugugaccagcaccuacggcuggacagccaauauggagcggaucaugaaagcccaggcacuucgggacaacuccaccaugggcuauaugauggccaaaaagcaccuggagaucaacccugaccaccccauuguggagacgcugcggcagaaggcugaggccgacaagaaugauaaggcaguuaaggaccugguggugcugcuguuugaaaccgcccugcuaucuucuggcuuuucccuugaggauccccagacccacuccaaccgcaucuaucgcaugaucaagcuaggucuagguauugaugaagaugaaguggcagcagaggaacccaaugcugcaguuccugaugagauccccccucucgagggcgaugaggaugcgucucgcauggaagaagucgauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6146 - RNA, 2759 nt, Artificial Sequence
  mRNA product Design3 comprising derived and/or modified sequence from Homo sapiens__NP_003290.1__HsHSP90B1 (wt)
gggagagucccgcagucggcguccagcggcucugcuuguucgugugugugucguugcaggccuuauucaagcuuaccaugagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcauucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcugguucguaaaacgcuggacaugaucaagaagauugcugaugauaaauacaaugauacuuuuuggaaagaauuugguaccaacaucaagcugggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagaacccgaagaagaaccugaagagacagcagaagacacaacagaagacacagagcaagacgaagaugaagaaauggaugugggaacagaugaagaagaagaaacagcaaaggaaucuacagcugaaaaagaugaauuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6147 - RNA, 2462 nt, Artificial Sequence
  mRNA product Design3 comprising derived and/or modified sequence from Homo sapiens__NP_057376.2__HsTRAP1 (wt)
gggagagucccgcagucggcguccagcggcucugcuuguucgugugugugucguugcaggccuuauucaagcuuaccauggcgcgcgagcugcgggcgcugcugcuguggggccgccgccugcggccuuugcugcgggcgccggcgcuggcggccgugccgggaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguuccacuuccaaacaugaguuccaggccgagacaaagaagcuguuggacauuguugcccggucccuguacucagaaaaagagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccaggauacugguaucgggaugacacaggaagaacugguguccaaccuggggacgauugccagaucggggucaaaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugguucuggaguguuugaaaucgccgaagcaucgggaguuagaaccgggacaaaaaucaucauccaccugaaauccgacugcaaggaguuuuccagcgaggcccgggugcgagaugugguaacgaaguacagcaacuucgucagcuuccccuuguacuugaauggaaggcggaugaacaccuugcaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacaugaaaccguccauguuugaugugagccgggagcugggcuccagcguugcacuguacagccgcaaaguccucauccagaccaaggccacggacauccugcccaaguggcugcgcuucauccgaggugugguggacagugaggacauuccccugaaccucagccgggagcugcugcaggagagcgcacucaucaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagagguucucuucugcuuugagcaguuugaugagcucacccugcugcaccuucgugaguuugacaagaagaagcugaucucuguggagacggacauagucguggaucacuacaaggaggagaaguuugaggacagguccccagccgccgagugccuaucagagaaggagacggaggagcucauggccuggaugagaaaugugcuggggucgcgugucaccaacgugaaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggcacgcgcucaucaagaagcugaaucagcugcgcgcaagcgagccuggccuggcucagcugcugguggaucagauauacgagaacgccaugauugcugcuggacuuguugacgacccuagggccauggugggccgcuugaaugagcugcuugucaaggcccuggagcgacacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6148 - RNA, 809 nt, Artificial Sequence
  mRNA product Design3 comprising derived and/or modified sequence from Homo sapiens__NP_000609.1__HsIGF1 (wt)
gggagagucccgcagucggcguccagcggcucugcuuguucgugugugugucguugcaggccuuauucaagcuuaccaugggaaaaaucagcagucuuccaacccaauuauuuaagugcugcuuuugugauuucuugaaggugaagaugcacaccauguccuccucgcaucucuucuaccuggcgcugugccugcucaccuucaccagcucugccacggcuggaccggagacgcucugcggggcugagcugguggaugcucugcaguucguguguggagacaggggcuuuuauuucaacaagcccacaggguauggcuccagcagucggagggcgccucagacaggcaucguggaugagugcugcuuccggagcugugaucuaaggaggcuggagauguauugcgcaccccucaagccugccaagucagcucgcucuguccgugcccagcgccacaccgacaugcccaagacccagaaggaaguacauuugaagaacgcaaguagagggagugcaggaaacaagaacuacaggauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6149 - RNA, 986 nt, Artificial Sequence
  mRNA product Design3 comprising derived and/or modified sequence from Homo sapiens__NP_000591.1__HsIL6 (wt)
gggagagucccgcagucggcguccagcggcucugcuuguucgugugugugucguugcaggccuuauucaagcuuaccaugaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcugugcagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucugcggcaaauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6150 - RNA, 1628 nt, Artificial Sequence
  mRNA product Design3 comprising derived and/or modified sequence from Homo sapiens__NP_002183.1__HsINHBA (wt)
gggagagucccgcagucggcguccagcggcucugcuuguucgugugugugucguugcaggccuuauucaagcuuaccaugcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcugcaugugggcaaagucggggagaacggguauguggagauagaggaugacauuggaaggagggcagaaaugaaugaacuuauggagcagaccucggagaucaucacguuugccgagucaggaacagccaggaagacgcugcacuucgagauuuccaaggaaggcagugaccugucagugguggagcgugcagaagucuggcuguuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaaaagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6151 - RNA, 3806 nt, Artificial Sequence
  mRNA product Design3 comprising derived and/or modified sequence from Homo sapiens__NP_000623.2__HsITGAM (wt)
gggagagucccgcagucggcguccagcggcucugcuuguucgugugugugucguugcaggccuuauucaagcuuaccauggcucucagaguccuucuguuaacagccuugaccuuaugucauggguucaacuuggacacugaaaacgcaaugaccuuccaagagaacgcaaggggcuucgggcagagcgugguccagcuucagggauccaggguggugguuggagccccccaggagauaguggcugccaaccaaaggggcagccucuaccagugcgacuacagcacaggcucaugcgagcccauccgccugcagguccccguggaggccgugaacaugucccugggccugucccuggcagccaccaccagccccccucagcugcuggccuguggucccaccgugcaccagacuugcagugagaacacguaugugaaagggcucugcuuccuguuuggauccaaccuacggcagcagccccagaaguucccagaggcccuccgaggguguccucaagaggauagugacauugccuucuugauugauggcucugguagcaucaucccacaugacuuucggcggaugaaggaguuugucucaacugugauggagcaauuaaaaaaguccaaaaccuuguucucuuugaugcaguacucugaagaguuccggauucacuuuaccuucaaagaguuccagaacaacccuaacccaagaucacuggugaagccaauaacgcagcugcuugggcggacacacacggccacgggcauccgcaaagugguacgagagcuguuuaacaucaccaacggagcccgaaagaaugccuuuaagauccuaguugucaucacggauggagaaaaguuuggcgaucccuugggauaugaggaugucaucccugaggcagacagagagggagucauucgcuacgucauuggggugggagaugccuuccgcagugagaaaucccgccaagagcuuaauaccaucgcauccaagccgccucgugaucacguguuccaggugaauaacuuugaggcucugaagaccauucagaaccagcuucgggagaagaucuuugcgaucgaggguacucagacaggaaguagcagcuccuuugagcaugagaugucucaggaaggcuucagcgcugccaucaccucuaauggccccuugcugagcacuguggggagcuaugacugggcugguggagucuuucuauauacaucaaaggagaaaagcaccuucaucaacaugaccagaguggauucagacaugaaugaugcuuacuuggguuaugcugccgccaucaucuuacggaaccgggugcaaagccugguucugggggcaccucgauaucagcacaucggccugguagcgauguucaggcagaacacuggcaugugggaguccaacgcuaaugucaagggcacccagaucggcgccuacuucggggccucccucugcuccguggacguggacagcaacggcagcaccgaccugguccucaucggggccccccauuacuacgagcagacccgagggggccagguguccgugugccccuugcccagggggagggcucgguggcagugugaugcuguucucuacggggagcagggccaacccuggggccgcuuuggggcagcccuaacagugcugggggacguaaauggggacaagcugacggacguggccauuggggccccaggagaggaggacaaccggggugcuguuuaccuguuucacggaaccucaggaucuggcaucagccccucccauagccagcggauagcaggcuccaagcucucucccaggcuccaguauuuuggucagucacugagugggggccaggaccucacaauggauggacugguagaccugacuguaggagcccaggggcacgugcugcugcucaggucccagccaguacugagagucaaggcaaucauggaguucaaucccagggaaguggcaaggaauguauuugaguguaaugaucagguggugaaaggcaaggaagccggagaggucagagucugccuccauguccagaaaagcacacgggaucggcuaagagaaggacagauccagaguguugugacuuaugaccuggcucuggacuccggccgcccacauucccgcgccgucuucaaugagacaaagaacagcacacgcagacagacacaggucuuggggcugacccagacuugugagacccugaaacuacaguugccgaauugcaucgaggacccagugagccccauugugcugcgccugaacuucucucuggugggaacgccauugucugcuuucgggaaccuccggccagugcuggcggaggaugcucagagacucuucacagccuuguuucccuuugagaagaauuguggcaaugacaacaucugccaggaugaccucagcaucaccuucaguuucaugagccuggacugccucguggugggugggccccgggaguucaacgugacagugacugugagaaaugauggugaggacuccuacaggacacaggucaccuucuucuucccgcuugaccuguccuaccggaagguguccacgcuccagaaccagcgcucacagcgauccuggcgccuggccugugagucugccuccuccaccgaagugucuggggccuugaaaagcaccagcugcagcauaaaccaccccaucuucccggaaaacucagaggucaccuuuaauaucacguuugauguagacucuaaggcuucccuuggaaacaaacugcuccucaaggccaaugugaccagugagaacaacaugcccagaaccaacaaaaccgaguuccaacuggagcugccggugaaauaugcugucuacaugguggucaccagccauggggucuccacuaaauaucucaacuucacggccucagagaauaccagucgggucaugcagcaucaauaucaggucagcaaccuggggcagaggagccuccccaucagccugguguucuuggugcccguccggcugaaccagacugucauaugggaccgcccccaggucaccuucuccgagaaccucucgaguacgugccacaccaaggagcgcuugcccucucacuccgacuuucuggcugagcuucggaaggcccccguggugaacugcuccaucgcugucugccagagaauccagugugacaucccguucuuuggcauccaggaagaguucaaugcuacccucaaaggcaaccucucguuugacugguacaucaagaccucgcauaaccaccuccugaucgugagcacagcugagaucuuguuuaacgauuccguguucacccugcugccgggacagggggcguuugugaggucccagacggagaccaaaguggagccguucgagguccccaacccccugccgcucaucgugggcagcucugucgggggacugcugcuccuggcccucaucaccgccgcgcuguacaagcucggcuucuucaagcggcaauacaaggacaugaugagugaagggggucccccgggggccgaaccccaguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6152 - RNA, 1751 nt, Artificial Sequence
  mRNA product Design3 comprising derived and/or modified sequence from Homo sapiens__NP_002415.1__HsMMP8 (wt)
gggagagucccgcagucggcguccagcggcucugcuuguucgugugugugucguugcaggccuuauucaagcuuaccauguucucccugaagacgcuuccauuucugcucuuacuccaugugcagauuuccaaggccuuuccuguaucuucuaaagagaaaaauacaaaaacuguucaggacuaccuggaaaaguucuaccaauuaccaagcaaccaguaucagucuacaaggaagaauggcacuaaugugaucguugaaaagcugaaagaaaugcagcgauuuuuuggguugaaugugacggggaagccaaaugaggaaacucuggacaugaugaaaaagccucgcuguggagugccugacaguggugguuuuauguuaaccccaggaaaccccaagugggaacgcacuaacuugaccuacaggauucgaaacuauaccccacagcugucagaggcugagguagaaagagcuaucaaggaugccuuugaacucuggaguguugcaucaccucucaucuucaccaggaucucacagggagaggcagauaucaacauugcuuuuuaccaaagagaucacggugacaauucuccauuugauggacccaauggaauccuugcucaugccuuucagccaggccaagguauuggaggagaugcucauuuugaugccgaagaaacauggaccaacaccuccgcaaauuacaacuuguuucuuguugcugcucaugaauuuggccauucuuuggggcucgcucacuccucugacccuggugccuugauguaucccaacuaugcuuucagggaaaccagcaacuacucacucccucaagaugacaucgauggcauucaggccaucuauggacuuucaagcaacccuauccaaccuacuggaccaagcacacccaaacccugugaccccaguuugacauuugaugcuaucaccacacuccguggagaaauacuuuucuuuaaagacagguacuucuggagaaggcauccucagcuacaaagagucgaaaugaauuuuauuucucuauucuggccaucccuuccaacugguauacaggcugcuuaugaagauuuugacagagaccucauuuuccuauuuaaaggcaaccaauacugggcucugaguggcuaugauauucugcaagguuaucccaaggauauaucaaacuauggcuuccccagcagcguccaagcaauugacgcagcuguuuucuacagaaguaaaacauacuucuuuguaaaugaccaauucuggagauaugauaaccaaagacaauucauggagccagguuaucccaaaagcauaucaggugccuuuccaggaauagagaguaaaguugaugcaguuuuccagcaagaacauuucuuccaugucuucaguggaccaagauauuacgcauuugaucuuauugcucagagaguuaccagaguugcaagaggcaauaaauggcuuaacuguagauauggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6153 - RNA, 2471 nt, Artificial Sequence
  mRNA product Design3 comprising derived and/or modified sequence from Homo sapiens__NP_004985.2__HsMMP9 (wt)
gggagagucccgcagucggcguccagcggcucugcuuguucgugugugugucguugcaggccuuauucaagcuuaccaugagccucuggcagccccugguccuggugcuccuggugcugggcugcugcuuugcugcccccagacagcgccaguccacccuugugcuguucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcuguucggcuucugcccgacccgagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuguucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6154 - RNA, 1415 nt, Artificial Sequence
  mRNA product Design3 comprising derived and/or modified sequence from Homo sapiens__NP_001286.1__HsCCR1 (wt)
gggagagucccgcagucggcguccagcggcucugcuuguucgugugugugucguugcaggccuuauucaagcuuaccauggaaacuccaaacaccacagaggacuaugacacgaccacagaguuugacuauggggaugcaacuccgugccagaaggugaacgagagggccuuuggggcccaacugcugcccccucuguacuccuugguauuugucauuggccugguuggaaacauccuggugguccugguccuugugcaauacaagaggcuaaaaaacaugaccagcaucuaccuccugaaccuggccauuucugaccugcuguuccuguucacgcuucccuucuggaucgacuacaaguugaaggaugacuggguuuuuggugaugccauguguaagauccucucuggguuuuauuacacaggcuuguacagcgagaucuuuuucaucauccugcugacgauugacagguaccuggccaucguccacgccguguuugccuugcgggcacggaccgucacuuuuggugucaucaccagcaucaucauuugggcccuggccaucuuggcuuccaugccaggcuuauacuuuuccaagacccaaugggaguucacucaccacaccuguagccuucacuuuccucacgaaagccuacgagaguggaagcuguuucaggcucugaaacugaaccucuuugggcugguauugccuuuguuggucaugaucaucugcuacacagggauuauaaagauucugcuaagacgaccaaaugagaagaaauccaaagcuguccguuugauuuuugucaucaugaucaucuuuuuucucuuuuggacccccuacaauuugacuauacuuauuucuguuuuccaagacuuccuguucacccaugagugugagcagagcagacauuuggaccuggcugugcaagugacggaggugaucgccuacacgcacugcugugucaacccagugaucuacgccuucguuggugagagguuccggaaguaccugcggcaguuguuccacaggcguguggcugugcaccugguuaaauggcuccccuuccucuccguggacaggcuggagagggucagcuccacaucucccuccacaggggagcaugaacucucugcuggguucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6155 - RNA, 1073 nt, Artificial Sequence
  mRNA product Design3 comprising derived and/or modified sequence from Homo sapiens__NP_002599.1__HsPDGFB (wt)
gggagagucccgcagucggcguccagcggcucugcuuguucgugugugugucguugcaggccuuauucaagcuuaccaugaaucgcugcugggcgcuguuccugucucucugcugcuaccugcgucuggucagcgccgagggggaccccauucccgaggagcuuuaugagaugcugagugaccacucgauccgcuccuuugaugaucuccaacgccugcugcacggagaccccggagaggaagauggggccgaguuggaccugaacaugacccgcucccacucuggaggcgagcuggagagcuuggcucguggaagaaggagccuggguucccugaccauugcugagccggccaugaucgccgagugcaagacgcgcaccgagguguucgagaucucccggcgccucauagaccgcaccaacgccaacuuccugguguggccgcccuguguggaggugcagcgcugcuccggcugcugcaacaaccgcaacgugcagugccgccccacccaggugcagcugcgaccuguccaggugagaaagaucgagauugugcggaagaagccaaucuuuaagaaggccacggugacgcuggaagaccaccuggcaugcaagugugagacaguggcagcugcacggccugugacccgaagcccgggggguucccaggagcagcgagccaaaacgccccaaacucgggugaccauucggacggugcgaguccgccggccccccaagggcaagcaccggaaauucaagcacacgcaugacaagacggcacugaaggagacccuuggagccuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6156 - RNA, 1442 nt, Artificial Sequence
  mRNA product Design3 comprising derived and/or modified sequence from Homo sapiens__NP_149126.1__HsPDGFD (wt)
gggagagucccgcagucggcguccagcggcucugcuuguucgugugugugucguugcaggccuuauucaagcuuaccaugcaccggcucaucuuugucuacacucuaaucugcgcaaacuuuugcagcugucgggacacuucugcaaccccgcagagcgcauccaucaaagcauugcgcaacgccaaccucaggcgagaugacuuguaccgaagagaugagaccauccaggugaaaggaaacggcuacgugcagaguccuagauucccgaacagcuaccccaggaaccugcuccugacauggcggcuucacucucaggagaauacacggauacagcuaguguuugacaaucaguuuggauuagaggaagcagaaaaugauaucuguagguaugauuuuguggaaguugaagauauauccgaaaccaguaccauuauuagaggacgaugguguggacacaaggaaguuccuccaaggauaaaaucaagaacgaaccaaauuaaaaucacauucaaguccgaugacuacuuuguggcuaaaccuggauucaagauuuauuauucuuugcuggaagauuuccaacccgcagcagcuucagagaccaacugggaaucugucacaagcucuauuucagggguauccuauaacucuccaucaguaacggaucccacucugauugcggaugcucuggacaaaaaaauugcagaauuugauacaguggaagaucugcucaaguacuucaauccagagucauggcaagaagaucuugagaauauguaucuggacaccccucgguaucgaggcaggucauaccaugaccggaagucaaaaguugaccuggauaggcucaaugaugaugccaagcguuacaguugcacucccaggaauuacucggucaauauaagagaagaacugaaguuggccaauguggucuucuuuccacguugccuccucgugcagcgcuguggaggaaauuguggcuguggaacugucaacuggagguccugcacaugcaauucagggaaaaccgugaaaaaguaucaugagguauuacaguuugagccuggccacaucaagaggagggguagagcuaagaccauggcucuaguugacauccaguuggaucaccaugaacgaugugauuguaucugcagcucaagaccaccucgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6157 - RNA, 1025 nt, Artificial Sequence
  mRNA product Design3 comprising derived and/or modified sequence from Homo sapiens__NP_003946.3__HsSOCS3 (wt)
gggagagucccgcagucggcguccagcggcucugcuuguucgugugugugucguugcaggccuuauucaagcuuaccauggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagggccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6158 - RNA, 1520 nt, Artificial Sequence
  mRNA product Design3 comprising derived and/or modified sequence from Homo sapiens__NP_000651.3__HsTGFB1 (wt)
gggagagucccgcagucggcguccagcggcucugcuuguucgugugugugucguugcaggccuuauucaagcuuaccaugccgcccuccgggcugcggcugcugccgcugcugcuaccgcugcuguggcuacuggugcugacgccuggccggccggccgcgggacuauccaccuguaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacgaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccagaaauacagcaacaauuccuggcgauaccucagcaaccggcugcuggcacccagcgacucgccagagugguuaucuuuugaugucaccggaguugugcggcagugguugagccguggaggggaaauugagggcuuucgccuuagcgcccacugcuccugugacagcagggauaacacacugcaaguggacaucaacggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6159 - RNA, 1592 nt, Artificial Sequence
  mRNA product Design3 comprising derived and/or modified sequence from Homo sapiens__NP_003229.1__HsTGFB2 (wt)
gggagagucccgcagucggcguccagcggcucugcuuguucgugugugugucguugcaggccuuauucaagcuuaccaugcacuacugugugcugagcgcuuuucugauccugcaucuggucacggucgcgcucagccugucuaccugcagcacacucgauauggaccaguucaugcgcaagaggaucgaggcgauccgcgggcagauccugagcaagcugaagcucaccagucccccagaagacuauccugagcccgaggaaguccccccggaggugauuuccaucuacaacagcaccagggacuugcuccaggagaaggcgagccggagggcggccgccugcgagcgcgagaggagcgacgaagaguacuacgccaaggagguuuacaaaauagacaugccgcccuucuuccccuccgaaaaugccaucccgcccacuuucuacagacccuacuucagaauuguucgauuugacgucucagcaauggagaagaaugcuuccaauuuggugaaagcagaguucagagucuuucguuugcagaacccaaaagccagagugccugaacaacggauugagcuauaucagauucucaaguccaaagauuuaacaucuccaacccagcgcuacaucgacagcaaaguugugaaaacaagagcagaaggcgaauggcucuccuucgauguaacugaugcuguucaugaauggcuucaccauaaagacaggaaccugggauuuaaaauuagcuuacacugucccugcugcacuuuuguaccaucuaauaauuacaucaucccaaauaaaagugaagaacuagaagcaagauuugcagguauugauggcaccuccacauauaccaguggugaucagaaaacuauaaaguccacuaggaaaaaaaacagugggaagaccccacaucuccugcuaauguuauugcccuccuacagacuugagucacaacagaccaaccggcggaagaagcgugcuuuggaugcggccuauugcuuuagaaaugugcaggauaauugcugccuacguccacuuuacauugauuucaagagggaucuaggguggaaauggauacacgaacccaaaggguacaaugccaacuucugugcuggagcaugcccguauuuauggaguucagacacucagcacagcaggguccugagcuuauauaauaccauaaauccagaagcaucugcuucuccuugcugcgugucccaagauuuagaaccucuaaccauucucuacuacauuggcaaaacacccaagauugaacagcuuucuaauaugauuguaaagucuugcaaaugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6160 - RNA, 1586 nt, Artificial Sequence
  mRNA product Design3 comprising derived and/or modified sequence from Homo sapiens__NP_003230.1__HsTGFB3 (wt)
gggagagucccgcagucggcguccagcggcucugcuuguucgugugugugucguugcaggccuuauucaagcuuaccaugaagaugcacuugcaaagggcucuggugguccuggcccugcugaacuuugccacggucagccucucucuguccacuugcaccaccuuggacuucggccacaucaagaagaagaggguggaagccauuaggggacagaucuugagcaagcucaggcucaccagccccccugagccaacggugaugacccacguccccuaucagguccuggcccuuuacaacagcacccgggagcugcuggaggagaugcauggggagagggaggaaggcugcacccaggaaaacaccgagucggaauacuaugccaaagaaauccauaaauucgacaugauccaggggcuggcggagcacaacgaacuggcugucugcccuaaaggaauuaccuccaagguuuuccgcuucaauguguccucaguggagaaaaauagaaccaaccuauuccgagcagaguuccgggucuugcgggugcccaaccccagcucuaagcggaaugagcagaggaucgagcuguuccagauccuucggccagaugagcacauugccaaacagcgcuauaucgguggcaagaaucugcccacacggggcacugccgaguggcuguccuuugaugucacugacacugugcgugaguggcuguugagaagagaguccaacuuaggucuagaaaucagcauucacuguccaugucacaccuuucagcccaauggagauauccuggaaaacauucacgaggugauggaaaucaaauucaaaggcguggacaaugaggaugaccauggccguggagaucuggggcgccucaagaagcagaaggaucaccacaacccucaucuaauccucaugaugauucccccacaccggcucgacaacccgggccaggggggucagaggaagaagcgggcuuuggacaccaauuacugcuuccgcaacuuggaggagaacugcugugugcgcccccucuacauugacuuccgacaggaucugggcuggaaguggguccaugaaccuaagggcuacuaugccaacuucugcucaggcccuugcccauaccuccgcagugcagacacaacccacagcacggugcugggacuguacaacacucugaacccugaagcaucugccucgccuugcugcgugccccaggaccuggagccccugaccauccuguacuauguugggaggacccccaaaguggagcagcucuccaacaugguggugaagucuuguaaauguagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6161 - RNA, 1733 nt, Artificial Sequence
  mRNA product Design3 comprising derived and/or modified sequence from Homo sapiens__NP_001057.1__HsTNFRSF1B (wt)
gggagagucccgcagucggcguccagcggcucugcuuguucgugugugugucguugcaggccuuauucaagcuuaccauggcgcccgucgccgucugggccgcgcuggccgucggacuggagcucugggcugcggcgcacgccuugcccgcccagguggcauuuacacccuacgccccggagcccgggagcacaugccggcucagagaauacuaugaccagacagcucagaugugcugcagcaaaugcucgccgggccaacaugcaaaagucuucuguaccaagaccucggacaccgugugugacuccugugaggacagcacauacacccagcucuggaacuggguucccgagugcuugagcuguggcucccgcuguagcucugaccagguggaaacucaagccugcacucgggaacagaaccgcaucugcaccuguaggcccggcugguacugcgcgcugagcaagcaggaggggugccggcugugcgcgccgcugcgcaagugccgcccgggcuucggcguggccagaccaggaacugaaacaucagacguggugugcaagcccugugccccggggacguucuccaacacgacuucauccacggauauuugcaggccccaccagaucuguaacgugguggccaucccugggaaugcaagcauggaugcagucugcacguccacgucccccacccggaguauggccccaggggcaguacacuuaccccagccaguguccacacgaucccaacacacgcagccaacuccagaacccagcacugcuccaagcaccuccuuccugcucccaaugggccccagccccccagcugaagggagcacuggcgacuucgcucugccaguuggacugauugugggugugacagccuugggucuacuaauaauaggaguggugaacugugucaucaugacccaggugaaaaagaagcccuugugccugcagagagaagccaaggugccucacuugccugccgauaaggcccgggguacacagggccccgagcagcagcaccuccugaucacagcgccgagcuccagcagcagcucccuggagagcucggccagugcguuggacagaagggcgcccacucggaaccagccacaggcaccaggcguggaggccaguggggccggggaggcccgggccagcaccgggagcucagauucuuccccugguggccaugggacccaggucaaugucaccuguaucgugaacgucuguagcagcucugaccacagcucacagugcuccucccaagccagcuccacaaugggagacacagauuccagccccucggaguccccgaaggacgagcagguccccuucuccaaggaggaaugugccuuucggucacagcuggagacgccagagacccugcuggggagcaccgaagagaagccccugccccuuggagugccugaugcugggaugaagcccaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6162 - RNA, 1412 nt, Artificial Sequence
  mRNA product Design3 comprising derived and/or modified sequence from Homo sapiens__NP_004460.1__HsVEGFD (wt)
gggagagucccgcagucggcguccagcggcucugcuuguucgugugugugucguugcaggccuuauucaagcuuaccauguacagagaguggguaguggugaauguuuucaugauguuguacguccagcuggugcagggcuccaguaaugaacauggaccagugaagcgaucaucucaguccacauuggaacgaucugaacagcagaucagggcugcuucuaguuuggaggaacuacuucgaauuacucacucugaggacuggaagcuguggagaugcaggcugaggcucaaaaguuuuaccaguauggacucucgcucagcaucccaucgguccacuagguuugcggcaacuuucuaugacauugaaacacuaaaaguuauagaugaagaauggcaaagaacucagugcagcccuagagaaacgugcguggagguggccagugagcuggggaagaguaccaacacauucuucaagcccccuugugugaacguguuccgaugugguggcuguugcaaugaagagagccuuaucuguaugaacaccagcaccucguacauuuccaaacagcucuuugagauaucagugccuuugacaucaguaccugaauuagugccuguuaaaguugccaaucauacagguuguaagugcuugccaacagccccccgccauccauacucaauuaucagaagauccauccagaucccugaagaagaucgcuguucccauuccaagaaacucuguccuauugacaugcuaugggauagcaacaaauguaaauguguuuugcaggaggaaaauccacuugcuggaacagaagaccacucucaucuccaggaaccagcucucugugggccacacaugauguuugacgaagaucguugcgagugugucuguaaaacaccaugucccaaagaucuaauccagcaccccaaaaacugcaguugcuuugagugcaaagaaagucuggagaccugcugccagaagcacaagcuauuucacccagacaccuguagcugugaggacagaugccccuuucauaccagaccaugugcaaguggcaaaacagcaugugcaaagcauugccgcuuuccaaaggagaaaagggcugcccaggggccccacagccgaaagaauccuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 6163 - RNA, 810 nt, Artificial Sequence
  mRNA product Design5 comprising derived and/or modified sequence from Sus scrofa__P45561-2__SsAMELX-001-2 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuauauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6164 - RNA, 846 nt, Artificial Sequence
  mRNA product Design5 comprising derived and/or modified sequence from Sus scrofa__NP_998965.1__SsAMELX-001-3 (wt)
gggagagucccgcagucggcguccagcggcucugcuuguucgugugugugucguugcaggccuuauucaagcuuaccauggggaccuggauuuucuuugccugccuuuugggagcaucccuugcuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6165 - RNA, 495 nt, Artificial Sequence
  mRNA product Design5 comprising derived and/or modified sequence from Sus scrofa__K7GPB2__SsAMELX-002 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6166 - RNA, 888 nt, Artificial Sequence
  mRNA product Design5 comprising derived and/or modified sequence from Sus scrofa__K7GLD0__SsAMELX-003 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggacuuauacuuggaggcuauccguauugacaggacugcauucgugcuuaccccucugaagugguaccagaacaugauaagacauccguacacuuccuaugguuacgaacccauggguggauggcugcaccaccaaaucauucccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6167 - RNA, 774 nt, Artificial Sequence
  mRNA product Design5 comprising derived and/or modified sequence from Sus scrofa__K7GPE9__SsAMELX-004 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6168 - RNA, 798 nt, Artificial Sequence
  mRNA product Design5 comprising derived and/or modified sequence from Sus scrofa__J9JIM4__SsAMELX-201 (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6169 - RNA, 3237 nt, Artificial Sequence
  mRNA product Design5 comprising derived and/or modified sequence from Homo sapiens__NP_006120.1__HsBMP1 (wt)
gggagagucccgcagucggcguccagcggcucugcuuguucgugugugugucguugcaggccuuauucaagcuuaccaugcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcggcugccuuucuuggggacauugcccuggacgaagaggaccugagggccuuccagguacagcaggcuguggaucucagacggcacacagcucguaaguccuccaucaaagcugcaguuccaggaaacacuucuacccccagcugccagagcaccaacgggcagccucagaggggagccugugggagauggagagguagaucccguagccggcgggcggcgacgucccgaccagagcguguguggcccgauggggucauccccuuugucauugggggaaacuucacugguagccagagggcagucuuccggcaggccaugaggcacugggagaagcacaccugugucaccuuccuggagcgcacugacgaggacagcuauauuguguucaccuaucgaccuugcgggugcugcuccuacgugggucgccgcggcgggggcccccaggccaucuccaucggcaagaacugugacaaguucggcauugugguccacgagcugggccacgucgucggcuucuggcacgaacacacucggccagaccgggaccgccacguuuccaucguucgugagaacauccagccagggcaggaguauaacuuccugaagauggagccucaggagguggagucccugggggagaccuaugacuucgacagcaucaugcauuacgcucggaacacauucuccaggggcaucuuccuggauaccauuguccccaaguaugaggugaacggggugaaaccucccauuggccaaaggacacggcucagcaagggggacauugcccaagcccgcaagcuguacaagugcccagccuguggagagacccugcaagacagcacaggcaacuucuccuccccugaauaccccaauggcuacucugcucacaugcacugcguguggcgcaucucugucacacccggggagaagaucauccugaacuucacgucccuggaccuguaccgcagccgccugugcugguacgacuauguggagguccgagauggcuucuggaggaaggcgccccuccgaggccgcuucugcggguccaaacucccugagccuaucgucuccacugacagccgccucuggguugaguuccgcagcagcagcaauuggguuggaaagggcuucuuugcagucuacgaagccaucugcgggggugaugugaaaaaggacuauggccacauucaaucgcccaacuacccagacgauuaccggcccagcaaagucugcaucuggcggauccaggugucugagggcuuccacgugggccucacauuccaguccuuugagauugagcgccacgacagcugugccuacgacuaucuggaggugcgcgacgggcacagugagagcagcacccucaucgggcgcuacuguggcuaugagaagccugaugacaucaagagcacguccagccgccucuggcucaaguucgucucugacggguccauuaacaaagcgggcuuugccgucaacuuuuucaaagagguggacgagugcucucggcccaaccgcgggggcugugagcagcggugccucaacacccugggcagcuacaagugcagcugugaccccggguacgagcuggccccagacaagcgccgcugugaggcugcuuguggcggauuccucaccaagcucaacggcuccaucaccagcccgggcuggcccaaggaguacccccccaacaagaacugcaucuggcagcugguggcccccacccaguaccgcaucucccugcaguuugacuucuuugagacagagggcaaugaugugugcaaguacgacuucguggaggugcgcaguggacucacagcugacuccaagcugcauggcaaguucugugguucugagaagcccgaggucaucaccucccaguacaacaacaugcgcguggaguucaaguccgacaacaccguguccaaaaagggcuucaaggcccacuucuucucagacaaggacgagugcuccaaggauaacggcggcugccagcaggacugcgucaacacguucggcaguuaugagugccaaugccgcaguggcuucguccuccaugacaacaagcacgacugcaaagaagccggcugugaccacaaggugacauccaccagugguaccaucaccagccccaacuggccugacaaguaucccagcaagaaggagugcacgugggccaucuccagcacccccgggcaccgggucaagcugaccuucauggagauggacaucgagucccagccugagugugccuacgaccaccuagagguguucgacgggcgagacgccaaggcccccguccucggccgcuucugugggagcaagaagcccgagcccguccuggccacaggcagccgcauguuccugcgcuucuacucagauaacucgguccagcgaaagggcuuccaggccucccacgccacagagugcgggggccagguacgggcagacgugaagaccaaggaccuuuacucccacgcccaguuuggcgacaacaacuacccuggggguguggacugugagugggucauuguggccgaggaaggcuacggcguggagcucguguuccagaccuuugagguggaggaggagaccgacugcggcuaugacuacauggagcuguucgacggcuacgacagcacagcccccaggcuggggcgcuacuguggcucagggccuccugaggagguguacucggcgggagauucuguccuggugaaguuccacucggaugacaccaucaccaaaaaagguuuccaccuccgauacaccagcaccaaguuccaggacacacuccacagcaggaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6170 - RNA, 1467 nt, Artificial Sequence
  mRNA product Design5 comprising derived and/or modified sequence from Homo sapiens__NP_001191.1__HsBMP2 (wt)
gggagagucccgcagucggcguccagcggcucugcuuguucgugugugugucguugcaggccuuauucaagcuuaccaugguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcagaugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6171 - RNA, 1503 nt, Artificial Sequence
  mRNA product Design5 comprising derived and/or modified sequence from Homo sapiens__NP_001193.2__HsBMP4 (wt)
gggagagucccgcagucggcguccagcggcucugcuuguucgugugugugucguugcaggccuuauucaagcuuaccaugauuccugguaaccgaaugcugauggucguuuuauuaugccaaguccugcuaggaggcgcgagccaugcuaguuugauaccugagacggggaagaaaaaagucgccgagauucagggccacgcgggaggacgccgcucagggcagagccaugagcuccugcgggacuucgaggcgacacuucugcagauguuugggcugcgccgccgcccgcagccuagcaagagugccgucauuccggacuacaugcgggaucuuuaccggcuucagucuggggaggaggaggaagaacagauccacagcacuggucuugaguauccugagcgcccggccagccgggccaacaccgugaggagcuuccaccacgaagaacaucuggagaacaucccagggaccagugaaaacucugcuuuucguuuccucuuuaaccucagcagcaucccugagaacgaggugaucuccucugcagagcuucggcuguuccgggagcaggucgaccagggcccugauugggaaaggggcuuccaccguauaaacauuuaugagguuaugaagcccccagcagaaguggugccugggcaccucaucacacgacuacuggacacgagacugguccaccacaaugugacacggugggaaacuuuugaugugagcccugcgguccuucgcuggacccgggagaagcagccaaacuaugggcuagccauugaggugacucaccuccaucagacucggacccaccagggccagcaugucaggauuagccgaucguuaccucaagggagugggaauugggcccagcuccggccccuccuggucaccuuuggccaugauggccggggccaugccuugacccgacgccggagggccaagcguagcccuaagcaucacucacagcgggccaggaagaagaauaagaacugccggcgccacucgcucuauguggacuucagcgaugugggcuggaaugacuggauuguggccccaccaggcuaccaggccuucuacugccauggggacugccccuuuccacuggcugaccaccucaacucaaccaaccaugccauugugcagacccuggucaauucugucaauuccaguauccccaaagccuguugugugcccacugaacugagugccaucuccaugcuguaccuggaugaguaugauaaggugguacugaaaaauuaucaggagaugguaguagagggaugugggugccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6172 - RNA, 1818 nt, Artificial Sequence
  mRNA product Design5 comprising derived and/or modified sequence from Homo sapiens__NP_001709.1__HsBMP6 (wt)
gggagagucccgcagucggcguccagcggcucugcuuguucgugugugugucguugcaggccuuauucaagcuuaccaugccggggcuggggcggagggcgcaguggcugugcugguggugggggcugcugugcagcugcugcgggcccccgccgcugcggccgcccuugcccgcugccgcggccgccgccgccggggggcagcugcugggggacggcgggagccccggccgcacggagcagccgccgccgucgccgcaguccuccucgggcuuccuguaccggcggcucaagacgcaggagaagcgggagaugcagaaggagaucuugucggugcuggggcucccgcaccggccccggccccugcacggccuccaacagccgcagcccccggcgcuccggcagcaggaggagcagcagcagcagcagcagcugccucgcggagagcccccucccgggcgacugaaguccgcgccccucuucaugcuggaucuguacaacgcccuguccgccgacaacgacgaggacggggcgucggagggggagaggcagcaguccuggccccacgaagcagccagcucgucccagcgucggcagccgcccccgggcgccgcgcacccgcucaaccgcaagagccuucuggcccccggaucuggcagcggcggcgcguccccacugaccagcgcgcaggacagcgccuuccucaacgacgcggacauggucaugagcuuugugaaccugguggaguacgacaaggaguucuccccucgucagcgacaccacaaagaguucaaguucaacuuaucccagauuccugagggugagguggugacggcugcagaguuccgcaucuacaaggacuguguuauggggaguuuuaaaaaccaaacuuuucuuaucagcauuuaucaagucuuacaggagcaucagcacagagacucugaccuguuuuuguuggacacccguguaguaugggccucagaagaaggcuggcuggaauuugacaucacggccacuagcaaucuguggguugugacuccacagcauaacauggggcuucagcugagcguggugacaagggauggaguccacguccacccccgagccgcaggccuggugggcagagacggcccuuacgacaagcagcccuucaugguggcuuucuucaaagugagugaggugcacgugcgcaccaccaggucagccuccagccggcgccgacaacagagucguaaucgcucuacccagucccaggacguggcgcgggucuccagugcuucagauuacaacagcagugaauugaaaacagccugcaggaagcaugagcuguaugugaguuuccaagaccugggauggcaggacuggaucauugcacccaagggcuaugcugccaauuacugugauggagaaugcuccuucccacucaacgcacacaugaaugcaaccaaccacgcgauugugcagaccuugguucaccuuaugaaccccgaguauguccccaaaccgugcugugcgccaacuaagcuaaaugccaucucgguucuuuacuuugaugacaacuccaaugucauucugaaaaaauacaggaauaugguuguaagagcuuguggaugccacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6173 - RNA, 1572 nt, Artificial Sequence
  mRNA product Design5 comprising derived and/or modified sequence from Homo sapiens__NP_001710.1__HsBMP7 (wt)
gggagagucccgcagucggcguccagcggcucugcuuguucgugugugugucguugcaggccuuauucaagcuuaccaugcacgugcgcucacugcgagcugcggcgccgcacagcuucguggcgcucugggcaccccuguuccugcugcgcuccgcccuggccgacuucagccuggacaacgaggugcacucgagcuucauccaccggcgccuccgcagccaggagcggcgggagaugcagcgcgagauccucuccauuuugggcuugccccaccgcccgcgcccgcaccuccagggcaagcacaacucggcacccauguucaugcuggaccuguacaacgccauggcgguggaggagggcggcgggcccggcggccagggcuucuccuaccccuacaaggccgucuucaguacccagggccccccucuggccagccugcaagauagccauuuccucaccgacgccgacauggucaugagcuucgucaaccucguggaacaugacaaggaguucuuccacccacgcuaccaccaucgagaguuccgguuugaucuuuccaagaucccagaaggggaagcugucacggcagccgaguuccggaucuacaaggacuacauccgggaacgcuucgacaaugagacguuccggaucagcguuuaucaggugcuccaggagcacuugggcagggaaucggaucucuuccugcucgacagccguacccucugggccucggaggagggcuggcugguguuugacaucacagccaccagcaaccacuggguggucaauccgcggcacaaccugggccugcagcucucgguggagacgcuggaugggcagagcaucaaccccaaguuggcgggccugauugggcggcacgggccccagaacaagcagcccuucaugguggcuuucuucaaggccacggagguccacuuccgcagcauccgguccacggggagcaaacagcgcagccagaaccgcuccaagacgcccaagaaccaggaagcccugcggauggccaacguggcagagaacagcagcagcgaccagaggcaggccuguaagaagcacgagcuguaugucagcuuccgagaccugggcuggcaggacuggaucaucgcgccugaaggcuacgccgccuacuacugugagggggagugugccuucccucugaacuccuacaugaacgccaccaaccacgccaucgugcagacgcugguccacuucaucaacccggaaacggugcccaagcccugcugugcgcccacgcagcucaaugccaucuccguccucuacuucgaugacagcuccaacgucauccugaagaaauacagaaacauggugguccgggccuguggcugccacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6174 - RNA, 576 nt, Artificial Sequence
  mRNA product Design5 comprising derived and/or modified sequence from Homo sapiens__NP_006264.2__HsCCL7 (wt)
gggagagucccgcagucggcguccagcggcucugcuuguucgugugugugucguugcaggccuuauucaagcuuaccaugaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6175 - RNA, 3900 nt, Artificial Sequence
  mRNA product Design5 comprising derived and/or modified sequence from Homo sapiens__NP_001954.2__HsEGF (wt)
gggagagucccgcagucggcguccagcggcucugcuuguucgugugugugucguugcaggccuuauucaagcuuaccaugcugcucacucuuaucauucuguugccaguaguuucaaaauuuaguuuuguuagucucucagcaccgcagcacuggagcuguccugaagguacucucgcaggaaauggcaauucuacuuguguggguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccugagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcaggaggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcggagcuuucauaugcccuccuaugggacacagacccuugaagggggugucgagaagccccauucucuccuaucagcuaacccauuauggcaacaaagggcccuggacccaccacaccaaauggagcugacucagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6176 - RNA, 786 nt, Artificial Sequence
  mRNA product Design5 comprising derived and/or modified sequence from Homo sapiens__NP_001423.1__HsEREG (wt)
gggagagucccgcagucggcguccagcggcucugcuuguucgugugugugucguugcaggccuuauucaagcuuaccaugaccgcggggaggaggauggagaugcucugugccggcagggucccugcgcugcugcucugccuggguuuccaucuucuacaggcaguccucaguacaacugugauuccaucauguaucccaggagaguccagugauaacugcacagcuuuaguucagacagaagacaauccacguguggcucaagugucaauaacaaaguguagcucugacaugaauggcuauuguuugcauggacagugcaucuaucugguggacaugagucaaaacuacugcagaugugaaguggguuauacugguguccgaugugaacacuucuuuuuaaccguccaccaaccuuuaagcaaagaauauguggcuuugaccgugauucuuauuauuuuguuucuuaucacagucgucgguuccacauauuauuucugcagaugguacagaaaucgaaaaaguaaagaaccaaagaaggaauaugagagaguuaccucaggggauccagaguugccgcaagucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6177 - RNA, 1143 nt, Artificial Sequence
  mRNA product Design5 comprising derived and/or modified sequence from Homo sapiens__NP_001997.5__HsFGF2 (wt)
gggagagucccgcagucggcguccagcggcucugcuuguucgugugugugucguugcaggccuuauucaagcuuaccauggugggugugggggguggagauguagaagaugugacgccgcggcccggcgggugccagauuagcggacgcggugcccgcgguugcaacgggaucccgggcgcugcagcuugggaggcggcucuccccaggcggcguccgcggagacacccauccgugaaccccaggucccgggccgccggcucgccgcgcaccaggggccggcggacagaagaacggccgagcggcucgaggcugggggaccgcgggcgcggccgcgcgcugccgggcgggaggcuggggggccggggccggggccgugccccggagcgggucggaggccggggccggggccgggggacggcggcuccccgcgcggcuccagcggcucggggaucccggccgggccccgcagggaccauggcagccgggagcaucaccacgcugcccgccuugcccgaggauggcggcagcggcgccuucccgcccggccacuucaaggaccccaagcggcuguacugcaaaaacgggggcuucuuccugcgcauccaccccgacggccgaguugacgggguccgggaaaagagcgacccucacaucaagcuacaacuucaagcagaagagagaggaguugugucuaucaaaggagugugugcuaaccguuaccuggcuaugaaggaagauggaagauuacuggcuucuaaauguguuacggaugaguguuucuuuuuugaacgauuggaaucuaauaacuacaauacuuaccggucaaggaaauacaccaguugguauguggcacugaaacgaacugggcaguauaaacuuggauccaaaacaggaccugggcagaaagcuauacuuuuucuuccaaugucugcuaagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6178 - RNA, 861 nt, Artificial Sequence
  mRNA product Design5 comprising derived and/or modified sequence from Homo sapiens__NP_002000.1__HsFGF7 (wt)
gggagagucccgcagucggcguccagcggcucugcuuguucgugugugugucguugcaggccuuauucaagcuuaccaugcacaaauggauacugacauggauccugccaacuuugcucuacagaucaugcuuucacauuaucugucuaguggguacuauaucuuuagcuugcaaugacaugacuccagagcaaauggcuacaaaugugaacuguuccagcccugagcgacacacaagaaguuaugauuacauggaaggaggggauauaagagugagaagacucuucugucgaacacagugguaccugaggaucgauaaaagaggcaaaguaaaagggacccaagagaugaagaauaauuacaauaucauggaaaucaggacaguggcaguuggaauuguggcaaucaaagggguggaaagugaguucuaucuugcaaugaacaaggaaggaaaacucuaugcaaagaaagaaugcaaugaagauuguaacuucaaagaacuaauucuggaaaaccauuacaacacauaugcaucagcuaaauggacacacaacggaggggaaauguuuguugccuuaaaucaaaaggggauuccuguaagaggaaaaaaaacgaagaaagaacaaaaaacagcccacuuucuuccuauggcaauaacuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6179 - RNA, 2463 nt, Artificial Sequence
  mRNA product Design5 comprising derived and/or modified sequence from Homo sapiens__NP_000592.3__HsHGF (wt)
gggagagucccgcagucggcguccagcggcucugcuuguucgugugugugucguugcaggccuuauucaagcuuaccaugugggugaccaaacuccugccagcccugcugcugcagcauguccuccugcaucuccuccugcuccccaucgccauccccuaugcagagggacaaaggaaaagaagaaauacaauucaugaguucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaaucccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcauggcuuggaauccaugauguccacggaagaggagaugagaaaugcaaacagguucucaauguuucccagcugguauauggcccugaaggaucagaucugguuuuaaugaagcuggccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6180 - RNA, 2202 nt, Artificial Sequence
  mRNA product Design5 comprising derived and/or modified sequence from Homo sapiens__NP_005336.3 __HsHSPA1A (wt)
gggagagucccgcagucggcguccagcggcucugcuuguucgugugugugucguugcaggccuuauucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggucagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaaaagcgccguggaggaugaggggcucaagggcaagaucagcgaggcggacaagaagaaggugcuggacaagugucaagaggucaucucguggcuggacgccaacaccuuggccgagaaggacgaguuugagcacaagaggaaggagcuggagcaggucuguaaccccaucaucagcggacuguaccagggugccgguggucccgggccugggggcuucggggcucagggucccaagggagggucugggucaggccccaccauugaggagguagauuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6181 - RNA, 2202 nt, Artificial Sequence
  mRNA product Design5 comprising derived and/or modified sequence from Homo sapiens__NP_005337.2 __HsHSPA1B (wt)
gggagagucccgcagucggcguccagcggcucugcuuguucgugugugugucguugcaggccuuauucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggucagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaaaagcgccguggaggaugaggggcucaagggcaagaucagcgaggcggacaagaagaagguucuggacaagugucaagaggucaucucguggcuggacgccaacaccuuggccgagaaggacgaguuugagcacaagaggaaggagcuggagcaggucuguaaccccaucaucagcggacuguaccagggugccgguggucccgggccuggcggcuucggggcucagggucccaagggagggucugggucaggcccuaccauugaggagguggauuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6182 - RNA, 2202 nt, Artificial Sequence
  mRNA product Design5 comprising derived and/or modified sequence from Homo sapiens__NP_005518.3 __HsHSPA1L (wt)
gggagagucccgcagucggcguccagcggcucugcuuguucgugugugugucguugcaggccuuauucaagcuuaccauggcuacugccaagggaaucgccauaggcaucgaccugggcaccaccuacuccuguguggggguguuccagcacggcaagguggagaucaucgccaacgaccagggcaaccgcaccacccccagcuacguggccuucacagacaccgagcggcucauuggggaugcggccaagaaccagguagcaaugaauccccagaacacuguuuuugaugcuaaacgucugaucggcaggaaauuuaaugauccuguuguacaagcagauaugaaacuuuggccuuuucaagugauuaaugaaggaggcaagcccaaaguccuuguguccuacaaaggggagaauaaagcauucuacccugaggaaaucucuucgaugguauugacuaaguugaaggagacugcugaggccuuuuugggccacccugucaccaaugcagugauuaccgugccagccuauuucaaugacucucaacgucaggcuacuaaggaugcaggagugauugcuggacuuaaugugcuaagaaucaucaaugagcccacggcugcugccauugccuaugguuuagauaaaggaggucaaggagaacgacauguccugauuuuugaucuggguggaggcacauuugaugugucaauucugaccauagaugaugggauuuuugagguaaaggccacugcuggggacacucaccuggguggggaggacuuugacaacaggcuugugagccacuucguggaggaguucaagaggaaacacaaaaaggacaucagccagaacaagcgagccgugaggcggcugcgcaccgccugcgagagggccaagaggacccugucguccagcacccaggccaaccuagaaauugauucacuuuaugaaggcauugacuucuauacauccaucaccagagcucgauuugaagaguugugugcagaccuguuuagggguacccuggagccuguagaaaaagcgcuucgggaugccaagauggauaaggcuaaaauccaugacauuguuuuaguagggggcuccacccgcauccccaaggugcagcggcugcuucaggacuacuucaauggacgugaucucaacaagagcaucaacccugaugaggccguagcauauggggcugcgguacaagcagccauccugaugggggacaagucugagaagguacaggaccugcugcugcuggacguggcuccccugucccuggggcuggagacggcugggggcgugaugacugcccugauaaagcgcaacuccaccauccccaccaagcagacacagauuuucaccaccuacucugacaaccaacccggggugcugauccagguguaugagggcgagagggccaugacaaaggacaacaaccugcuggggcgguuugaccugacuggaaucccuccagcacccaggggaguuccucagaucgaggugacguuugacauugaugccaaugguauucucaaugucacagccacggacaagagcaccggcaaggugaacaagaucaccaucaccaaugacaagggccgccugagcaaggaggagauugagcgcaugguucuggaugcugagaaauauaaagcugaagaugagguccagagggagaaaauugcugcaaagaaugccuuagaauccuaugcuuuuaacaugaagaguguugugagugaugaagguuugaagggcaagauuagugagucugauaaaaauaaaauauuggauaaaugcaacgagcuccuuucguggcuggaggucaaucaacuggcagagaaagaugaguuugaucauaagagaaaggaauuggagcagauguguaacccuaucaucacaaaacucuaccaaggaggaugcacugggccugccugcggaacaggguaugugccuggaaggccugccacaggccccacaauugaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6183 - RNA, 2799 nt, Artificial Sequence
  mRNA product Design5 comprising derived and/or modified sequence from Homo sapiens__NP_002145.3 __HsHSPA4 (wt)
gggagagucccgcagucggcguccagcggcucugcuuguucgugugugugucguugcaggccuuauucaagcuuaccaugucgguggugggcauagaccugggcuuccagagcugcuacgucgcuguggcccgcgccggcggcaucgagacuaucgcuaaugaguauagcgaccgcugcacgccggcuugcauuucuuuugguccuaagaaucguucaauuggagcagcagcuaaaagccagguaauuucuaaugcaaagaacacaguccaaggauuuaaaagauuccauggccgagcauucucugauccauuuguggaggcagaaaaaucuaaccuugcauaugauauugugcaguugccuacaggauuaacagguauaaaggugacauauauggaggaagaacgaaauuuuaccacugagcaagugacugccaugcuuuuguccaaacugaaggagacagccgaaaguguucuuaagaagccuguaguugacuguguuguuucgguuccuuguuucuauacugaugcagaaagacgaucagugauggaugcaacacagauugcuggucuuaauugcuugcgauuaaugaaugaaaccacugcaguugcucuugcauauggaaucuauaagcaggaucuuccugccuuagaagagaaaccaagaaauguaguuuuuguagacaugggccacucugcuuaucaaguuucuguaugugcauuuaauagaggaaaacugaaaguucuggccacugcauuugacacgacauugggagguagaaaauuugaugaaguguuaguaaaucacuucugugaagaauuugggaagaaauacaagcuagacauuaaguccaaaauccgugcauuauuacgacucucucaggagugugagaaacucaagaaauugaugagugcaaaugcuucagaucucccuuugagcauugaauguuuuaugaaugauguugauguaucuggaacuaugaauagaggcaaauuucuggagaugugcaaugaucucuuagcuagaguggagccaccacuucguaguguuuuggaacaaaccaaguuaaagaaagaagauauuuaugcaguggagauaguugguggugcuacacgaaucccugcgguaaaagagaagaucagcaaauuuuucgguaaagaacuuaguacaacauuaaaugcugaugaagcugucacucgaggcugugcauugcagugugccaucuuaucgccugcuuucaaagucagagaauuuucuaucacugauguaguaccauauccaauaucucugagauggaacucuccagcugaagaagggucaagugacugugaagucuuuuccaaaaaucaugcugcuccuuucucuaaaguucuuacauuuuauagaaaggaaccuuucacucuugaggccuacuacagcucuccucaggauuugcccuauccagauccugcuauagcucaguuuucaguucagaaagucacuccucagucugauggcuccaguucaaaagugaaagucaaaguucgaguaaauguccauggcauuuucaguguguccagugcaucuuuaguggagguucacaagucugaggaaaaugaggagccaauggaaacagaucagaaugcaaaggaggaagagaagaugcaaguggaccaggaggaaccacauguugaagaacaacagcagcagacaccagcagaaaauaaggcagagucugaagaaauggagaccucucaagcuggauccaaggauaaaaagauggaccaaccaccccaagccaagaaggcaaaagugaagaccaguacuguggaccugccaaucgagaaucagcuauuauggcagauagacagagagaugcucaacuuguacauugaaaaugaggguaagaugaucaugcaggauaaacuggagaaggagcggaaugaugcuaagaacgcaguggaggaauauguguaugaaaugagagacaagcugaguggugaauaugagaaguuugugagugaagaugaucguaacaguuuuacuuugaaacuggaagauacugaaaauugguuguaugaggauggagaagaccagccaaagcaaguuuauguugauaaguuggcugaauuaaaaaaucuaggucaaccuauuaagauacguuuccaggaaucugaagaacgaccaaaauuauuugaagaacuagggaaacagauccaacaguauaugaaaauaaucagcucuuucaaaaacaaggaggaccaguaugaucauuuggaugcugcugacaugacaaagguagaaaaaagcacaaaugaagcaauggaguggaugaauaacaagcuaaaucugcagaacaagcagaguuugaccauggauccaguugucaagucaaaagagauugaagcuaaaauuaaggagcugacaaguacuuguagcccuauaauuucaaagcccaaacccaaaguggaaccuccaaaagaggaacaaaaaaaugcagagcagaauggaccaguggauggacaaggagacaacccaggcccccaggcugcugagcaggguacagacacagcugugccuucggauucagacaagaagcugccugaaauggacauugauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6184 - RNA, 2796 nt, Artificial Sequence
  mRNA product Design5 comprising derived and/or modified sequence from Homo sapiens__NP_055093.2 __HsHSPA4L (wt)
gggagagucccgcagucggcguccagcggcucugcuuguucgugugugugucguugcaggccuuauucaagcuuaccaugucugugguuggcauugaccucggcuuucucaacugcuacauugcugucgcgagaaguggcggcaucgagaccaucgccaaugaguacagcgacagguguaccccggccuguauaucauugggaucaagaacucgagccauuggaaaugcagcaaagagccagauagucacgaacguaagaaauacaauucauggcuucaaaaagcugcaugggcgaucauuugaugaucccauugugcaaacugaaaggaucaggcuucccuaugaacugcagaaaaugccuaauggaagugcaggaguuaaggugcgguacuuagaggaagagagaccuuuugcaauugagcaaguuacuggaaugcuguuagccaagcugaaagagacuucagaaaaugcuuugaagaaaccaguggcugacugugugauuucaauuccuagcuuuuuuacugaugccgagagaagaucugugauggcugcagcccagguugcaggcuuaaauuguuuaagguugaugaaugaaacuacugcaguugcacuggcguauggaauuuauaaacaggaucuucccccauuagaugagaaaccaagaaauguaguauuuauugauaugggacauucugccuaucaggucuugguuugugcuuuuaacaaaggaaaacuuaaagucuuggcuacuaccuuugauccauauuuggguggcaggaacuuugaugaggcuuuaguagacuacuucugugaugaguucaagaccaaauauaagauaaaugugaaagaaaacucucgggccuuguugcguuuauaucaggaaugugaaaaacuaaagaagcuaaugagugcaaaugcaucagaucuuccauugaacauugaguguuucaugaaugaccuugauguuucuaguaaaaugaacagggcucaauuugaacaacugugugcuucccuuuuggccaggguugaaccaccuuuaaaagcaguaauggaacaagcuaacuuacaacgugaagacauuaguaguauagaaauuguaggaggagcaacacgaaucccugcagugaaagaacaaaucacuaaauucuuucuuaaagacauaaguaccacauuaaaugcugaugaagcuguugcaagaggaugugcguuacagugugcgauucucucaccagcauuuaaagugcgugaauuuuccauaacagaccuuguucccuauucaaucacauuaagguggaagaccucuuuugaagauggaaguggggaaugugaaguuuucuguaagaaccauccugccccauucucaaaagucauuacuuuccacaagaaggaaccauuugaacuagaagcauuuuauacuaauuuacaugaagugccuuauccugaugcaagaauugggagcuucacuauucagaauguuuuuccacagucugauggugauaguuccaaagugaagguuaaaguucguguuaacauccauggaaucuucaguguggcuagcgcaucaguaauugagaagcaaaauuuggaaggcgaucacagugaugcuccaauggagacagaaacuucauuuaaaaaugaaaacaaagauaauauggauaaaaugcagguugaucaagaagaagggcaucaaaaaugucaugcugaacacacuccagaagaggaaauugaucauacaggagccaaaacaaagucagcugucucagacaaacaagaccgauuaaaucagacacuuaaaaaaggaaaagucaaaaguauugaucuaccgauccagaguagccuauguagacaacuaggccaagaucuucucaacagcuacauugaaaaugaggggaagaugaucaugcaagauaaguuagagaaagaaagaaaugaugcuaagaaugccguugaagaauauguauaugauuuuagagacaggcugggcacugucuaugaaaaauucaucacuccagaagacuugaguaaacugucugcaguauuggaagacacagaaaauuggcuuuaugaagacggagaggaccaaccuaaacaaguuuauguggauaagcugcaagaacuaaagaaauacggccagccuauucaaaugaaguacauggagcaugaagagagaccaaaagccuuaaaugacuugggaaaaaagauccaacuugucaugaaagugauagaagcauauagaaacaaggaugaaagauaugaucaucuggauccuacugaaauggaaaagguugaaaaauguaucagugaugccaugaguuggcugaauaguaagaugaaugcacagaacaaacuaagucucacucaagauccugugguaaaaguuucagaaauaguagcaaagucaaaggaacuggauaauuucuguaaccccaucauuuacaagcccaaaccaaaagcagaaguuccugaagacaaaccaaaagcuaauagugaacacaauggcccaauggauggacagaguggaacugaaacuaaaucagauucaacaaaagacagcucacagcauacuaaauccucuggagagauggaaguggacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6185 - RNA, 2241 nt, Artificial Sequence
  mRNA product Design5 comprising derived and/or modified sequence from Homo sapiens__NP_005338.1__HsHSPA5 (wt)
gggagagucccgcagucggcguccagcggcucugcuuguucgugugugugucguugcaggccuuauucaagcuuaccaugaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagaacucaacauggaucuguuccggucuacuaugaagcccguccagaaaguguuggaagauucugauuugaagaagucugauauugaugaaauuguucuuguugguggcucgacucgaaucccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaaucccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6186 - RNA, 2208 nt, Artificial Sequence
  mRNA product Design5 comprising derived and/or modified sequence from Homo sapiens__NP_002146.2__HsHSPA6 (wt)
gggagagucccgcagucggcguccagcggcucugcuuguucgugugugugucguugcaggccuuauucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccggguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccgccuauuucaaugacucgcagcgccaggccaccaaggacgcgggggccaucgcggggcucaacguguugcggaucaucaaugagcccacggcagcugccaucgccuaugggcuggaccggcggggcgcgggagagcgcaacgugcucauuuuugaccugggugggggcaccuucgaugugucgguucucuccauugacgcuggugucuuugaggugaaagccacugcuggagauacccaccugggaggagaggacuucgacaaccggcucgugaaccacuucauggaagaguuccggcggaagcaugggaaggaccugagcgggaacaagcgugcccugcgcaggcugcgcacagccugugagcgcgccaagcgcacccuguccuccagcacccaggccacccuggagauagacucccuguucgagggcguggacuucuacacguccaucacucgugcccgcuuugaggaacugugcucagaccucuuccgcagcacccuggagccgguggagaaggcccugcgggaugccaagcuggacaaggcccagauucaugacgucguccugguggggggcuccacacgcauccccaaggugcagaaguugcugcaggacuucuucaacggcaaggagcugaacaagagcaucaacccugaugaggcuguggccuauggggcugcugugcaggcggccguguugaugggggacaaaugugagaaagugcaggaucuccugcugcuggauguggcuccccugucucuggggcuggagacagcaggaggggugaugaccacgcugauccagaggaacgccacuauccccaccaagcagacccagacuuucaccaccuacucggacaaccagccuggggucuucauccagguguaugagggugagagggccaugaccaaggacaacaaccugcuggggcguuuugaacucaguggcaucccuccugccccacguggagucccccagauagaggugacuuuugacauugaugcuaauggcauccugagcgugacagccacugacaggagcacagguaaggcuaacaagaucaccaucaccaaugacaagggccggcugagcaaggaggagguggagaggaugguucaugaagccgagcaguacaaggcugaggaugaggcccagagggacagaguggcugccaaaaacucgcuggaggcccaugucuuccaugugaaagguucuuugcaagaggaaagccuuagggacaagauucccgaagaggacaggcgcaaaaugcaagacaagugucgggaaguccuugccuggcuggagcacaaccagcuggcagagaaggaggaguaugagcaucagaagagggagcuggagcaaaucugucgccccaucuucuccaggcucuauggggggccuggugucccugggggcagcaguuguggcacucaagcccgccagggggaccccagcaccggccccaucauugaggagguugauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6187 - RNA, 1380 nt, Artificial Sequence
  mRNA product Design5 comprising derived and/or modified sequence from Homo sapiens__P48741__HsHSPA7 (wt)
gggagagucccgcagucggcguccagcggcucugcuuguucgugugugugucguugcaggccuuauucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccagguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccaccuauuucaguaacucgcagcgccaggccaccaaggacgcgggggccaucgcggggcucaaggugcugccgaucaucaaugaggccacggcagcagccaucgccuaugggcuggaccggcggggcgcgggaaagcgcaacgugcucauuuuugaccugggugggggcaccuucgaugugucgguucucuccauugacgccggugucuuugaggugaaagccacugcuggagauacccaccugggaggagaggacuucgacaaccggcucgugaaccacuucauggaagaguuccggcggaagcaugggaaggaccugagcgggaacaagcgugcccugcgcaggcugcgcacagccugugagcgcgccaagcgcaccccguccuccagcacccaggccacccuggagauagacucccuguucgagggcguggacuucuacaaguccaucacucgugcccgcuuugaggaacugugcucagaccucuuccgcagcacccuggagccgguggagaaggcccugcgggaugccaagcuggacaaggcccagauucaugacuucguccuggggggagggcuccacucgcauccccaaggugcagaaguugcugcaggacuucuucaacggcaaggagcugaacaagagcaucaacccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6188 - RNA, 2217 nt, Artificial Sequence
  mRNA product Design5 comprising derived and/or modified sequence from Homo sapiens__NP_006588.1 __HsHSPA8 (wt)
gggagagucccgcagucggcguccagcggcucugcuuguucgugugugugucguugcaggccuuauucaagcuuaccauguccaagggaccugcaguugguauugaucuuggcaccaccuacucuuguguggguguuuuccagcacggaaaagucgagauaauugccaaugaucagggaaaccgaaccacuccaagcuaugucgccuuuacggacacugaacgguugaucggugaugccgcaaagaaucaaguugcaaugaaccccaccaacacaguuuuugaugccaaacgucugauuggacgcagauuugaugaugcuguuguccagucugauaugaaacauuggcccuuuaugguggugaaugaugcuggcaggcccaagguccaaguagaauacaagggagagaccaagagcuucuauccagaggaggugucuucuaugguucugacaaagaugaaggaaauugcagaagccuaccuugggaagacuguuaccaaugcuguggucacagugccagcuuacuuuaaugacucucagcgucaggcuaccaaagaugcuggaacuauugcuggucucaauguacuuagaauuauuaaugagccaacugcugcugcuauugcuuacggcuuagacaaaaagguuggagcagaaagaaacgugcucaucuuugaccugggagguggcacuuuugaugugucaauccucacuauugaggauggaaucuuugaggucaagucuacagcuggagacacccacuuggguggagaagauuuugacaaccgaauggucaaccauuuuauugcugaguuuaagcgcaagcauaagaaggacaucagugagaacaagagagcuguaagacgccuccguacugcuugugaacgugcuaagcguacccucucuuccagcacccaggccaguauugagaucgauucucucuaugaaggaaucgacuucuauaccuccauuacccgugcccgauuugaagaacugaaugcugaccuguuccguggcacccuggacccaguagagaaagcccuucgagaugccaaacuagacaagucacagauucaugauauuguccugguuggugguucuacucguauccccaagauucagaagcugcuccaagacuucuucaauggaaaagaacugaauaagagcaucaacccugaugaagcuguugcuuauggugcagcuguccaggcagccaucuugucuggagacaagucugagaauguucaagauuugcugcucuuggaugucacuccucuuucccuugguauugaaacugcugguggagucaugacuguccucaucaagcguaauaccaccauuccuaccaagcagacacagaccuucacuaccuauucugacaaccagccuggugugcuuauucagguuuaugaaggcgagcgugccaugacaaaggauaacaaccugcuuggcaaguuugaacucacaggcauaccuccugcaccccgagguguuccucagauugaagucacuuuugacauugaugccaaugguauacucaaugucucugcuguggacaagaguacgggaaaagagaacaagauuacuaucacuaaugacaagggccguuugagcaaggaagacauugaacguaugguccaggaagcugagaaguacaaagcugaagaugagaagcagagggacaaggugucauccaagaacucacuugaguccuaugccuucaacaugaaagcaacuguugaagaugagaaacuucaaggcaagauuaacgaugaggacaaacagaagauucuggacaaguguaaugaaauuaucaacuggcuugauaagaaucagacugcugagaaggaagaauuugaacaucaacagaaagagcuggagaaaguuugcaaccccaucaucaccaagcuguaccagagugcaggaggcaugccaggaggaaugccugggggauuuccuggugguggagcuccucccucugguggugcuuccucagggcccaccauugaagagguugauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6189 - RNA, 2316 nt, Artificial Sequence
  mRNA product Design5 comprising derived and/or modified sequence from Homo sapiens__NP_004125.3 __HsHSPA9 (wt)
gggagagucccgcagucggcguccagcggcucugcuuguucgugugugugucguugcaggccuuauucaagcuuaccaugauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaaaagccagguauucucuacugccgcugauggucaaacgcaaguggaaauuaaagugugucagggugaaagagagauggcuggagacaacaaacuccuuggacaguuuacuuugauuggaaucccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaguucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucacugaagcuguucgaaauggcauacaaaaagauggcaucugagcgagaaggcucuggaaguucuggcacuggggaacaaaaggaagaucaaaaggaggaaaaacaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6190 - RNA, 2337 nt, Artificial Sequence
  mRNA product Design5 comprising derived and/or modified sequence from Homo sapiens__NP_443202.3 __HsHSPA12B (wt)
gggagagucccgcagucggcguccagcggcucugcuuguucgugugugugucguugcaggccuuauucaagcuuaccauguuggcugucccggagaugggccugcaggggcuguacaucggcuccagcccggagcgguccccagugccuagcccacccggcuccccgaggacccaggaaagcugcggcauugccccccucacacccucgcagucuccaaaacccgagguccgagccccccagcaggccuccuucucuguggugguggccauugacuucggcaccacgucuaguggcuaugcuuucagcuuugccagugacccugaggccauccacaugaugaggaaaugggagggcggagacccgggcguggcccaccagaagaccccgaccugccugcugcugacuccggagggcgccuuccacagcuuuggcuacaccgcccgcgauuacuaccaugaccuggaccccgaagaggcgcgggacuggcucuacuucgagaaguucaagaugaagauccacagcgccacggaucucaccuugaagacccagcuagaggcaguaaauggaaagacgaugcccgcccuggagguguucgcccaugcccugcgcuucuucagggagcacgcccuucaggagcugagggagcagagcccaucgcugccagagaaggacacugugcgcuggguguugacggugccugccaucuggaaacagccagccaagcaguucaugcgggaggcugccuaccuggcuggacuugugucccgagagaaugcagagcagcuacucaucgcccuggagcccgaggccgccucgguauacugccgcaagcugcgccugcaccagcuccuggaccugaguggccgggccccagguggugggcgccugggugagcgccgcuccaucgacuccagcuuccgucaggcucgggagcagcugcgaaggucccgccacagccgcacguuccugguggagucaggcguaggagagcugugggcagagaugcaagcaggagaccgcuacgugguggccgacugcggcggaggcaccguggaccugacggugcaccagcuggagcagccccauggcacccucaaggagcucuacaaggcaucugggggcccuuauggcgcggugggcguggaccuggccuucgagcagcugcugugccgcaucuucggcgaggacuucaucgccaccuucaaaaggcaacggccggcagccuggguagaucugaccaucgccuucgaggcucgcaagcgcacugcuggcccacaccgugcaggggcgcucaacaucucgcugcccuucuccuucauugacuucuaccgcaagcagcggggccacaacguggagaccgcucugcgcaggagcagcgugaacuucgugaagugguccucacaggggaugcuccgaaugucuugugaagccaugaacgagcucuuucagcccaccgucagcgggaucauccagcacauagaggcccugcuggcacggccggaggugcagggugugaagcugcuguuccuagugggcggcuucgccgagucagcggugcugcagcacgcggugcaggcggcgcugggcgcccgcggucugcgugucguggucccgcacgacgugggccucaccauccucaaaggcgcggugcuguucggccaggcgccgggcguggugcggguccgccgcucgccgcucaccuauggcgugggcgugcucaaccgcuuugugccugggcgccacccgcccgaaaagcugcugguucgcgacggccgccgcuggugcaccgacgucuucgagcgcuucguggccgccgagcagucgguggcccugggcgaggaggugcggcgcagcuacugcccggcgcgucccggccagcggcgcguacucaucaaccuguacugcugcgcggcagaggaugcgcgcuucaucaccgaccccggcgugcgcaaaugcggcgcgcucagccucgagcuugagcccgccgacugcggccaggacaccgccggcgcgccucccggccgccgcgagauccgcgccgccaugcaguuuggcgacaccgaaauuaaggucaccgccgucgacgucagcaccaaucgcuccgugcgcgcguccaucgacuuucuuuccaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6191 - RNA, 1806 nt, Artificial Sequence
  mRNA product Design5 comprising derived and/or modified sequence from Homo sapiens__NP_057383.2__HsHSPA14 (wt)
gggagagucccgcagucggcguccagcggcucugcuuguucgugugugugucguugcaggccuuauucaagcuuaccauggcggccaucggaguucaccugggcugcaccucagccuguguggccgucuauaaggauggccgggcuggugugguugcaaaugaugccggugaccgaguuacuccagcuguuguugcuuacucagaaaaugaagagauuguuggauuggcagcaaaacaaaguagaauaagaaauauuucaaauacaguaaugaaaguaaagcagauccugggcagaagcuccagugauccacaagcucagaaauacaucgcggaaaguaaauguuuagucauugaaaaaaaugggaaauuacgauaugaaauagauacuggagaagaaacaaaauuuguuaacccagaagauguugccagacugauauuuaguaaaaugaaagaaacggcacauucuguauugggcucagaugcaaaugauguaguuauuacugucccguuugauuuuggagaaaagcaaaaaaaugcucuuggagaagcagcuagagcugcuggauuuaauguuuugcgauuaauucacgaaccgucugcagcucugcuugcuuauggaauuggacaagacuccccuacuggaaaaagcaauauuuugguguuuaagcugggaggaacauccuuaucucucagcgucauggaaguuaacaguggaauauaucggguucuuucaacaaacacugaugauaacaucgguggugcacauuucacagaaaccuuagcacaguaucuagcuucugaguuccaaagauccuucaaacaugaugugagaggaaaugcgcgagccaugaugaaauuaacgaacagugcugaaguagcgaaacauucuuugucaaccuugggaagugccaacuguuuucuugacucauuauaugaaggucaagauuuugauugcaauguguccagagcaagauuugaacuucuuuguucuccacuuuuuaauaaguguauagaagcaaucagaggacucuuagaucaaaauggauuuacagcagaugauaucaacaagguuguccuuuguggagggucuucucgaaucccaaagcuacagcaacugauuaaagaucuuuucccagcuguugagcuucucaauucuaucccuccugaugaagugaucccuauuggugcagcuauagaagcaggaauccuuauugggaaagaaaaccuguugguggaagacucucuuaugauagaguguucagccagagauauuuuaguuaaggguguggacgaaucaggagccaguagauucacagugcuguuuccaucagggacuccuuugccagcucgaagacaacacacauugcaagccccuggaagcauaucuucagugugccuugaacucuaugagucugaugggaagaacucugccaaagaggaaaccaaguuugcacagguuguacuccaggauuuagauaaaaaagaaaauggauuacgugauauauuagcuguucuuacuaugaaaagggauggaucuuuacaugugacaugcacagaucaagaaacuggaaaaugugaagcaaucucuauugagauagcaucuuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6192 - RNA, 2853 nt, Artificial Sequence
  mRNA product Design5 comprising derived and/or modified sequence from Homo sapiens__NP_006635.2 __HsHSPH1 (wt)
gggagagucccgcagucggcguccagcggcucugcuuguucgugugugugucguugcaggccuuauucaagcuuaccaugucgguggugggguuggacgugggcucgcagagcugcuacaucgcgguagcccgggccgggggcaucgagaccaucgccaaugaguucagcgaccggugcaccccgucagucauaucauuuggaucaaaaaauagaacaaucggaguugcagccaaaaaucagcaaaucacucaugcaaacaauacggugucuaacuucaaaagauuucauggccgagcauucaaugaccccuucauucaaaaggagaaggaaaacuugaguuacgauuugguuccauugaaaaaugguggaguuggaauaaagguaauguacaugggugaagaacaucuauuuaguguggagcagauaacagccauguuguugacuaagcugaaggaaacugcugaaaacagccucaagaaaccaguaacagauuguguuauuucaguccccuccuucuuuacagaugcugagaggcgaucuguguuagaugcugcacagauuguuggccuaaacuguuuaagacuuaugaaugacaugacagcuguugcuuugaauuacggaauuuauaagcaggaucucccaagccuggaugagaaaccucggauagugguuuuuguugauaugggacauucagcuuuucaagugucugcuugugcuuuuaacaagggaaaauugaagguacugggaacagcuuuugauccuuucuuaggaggaaaaaacuucgaugaaaaguuaguggaacauuuuugugcagaauuuaaaacuaaguacaaguuggaugcaaaauccaaaauacgagcacuccuacgucuguaucaggaaugugaaaaacugaaaaagcuaaugagcucuaacagcacagaccuuccacugaauaucgaaugcuuuaugaaugauaaagauguuuccggaaagaugaacaggucacaauuugaagaacucugugcugaacuucugcaaaagauagaaguaccccuuuauucacuguuggaacaaacucaucucaaaguagaagaugugagugcaguugagauuguuggaggcgcuacacgaaucccagcugugaaggaaagaauugccaaauucuuuggaaaagauauuagcacaacacucaaugcagaugaagcaguagccagaggaugugcauuacagugugcaauacuuuccccggcauuuaaaguuagagaauuuuccgucacagaugcaguuccuuuuccaauaucucugaucuggaaccaugauucagaagauacugaagguguucaugaagucuuuagucgaaaccaugcugcuccuuucuccaaaguucucaccuuucugagaagggggccuuuugagcuagaagcauucuauucugauccccaaggaguuccauauccagaagcaaaaauaggccgcuuuguaguucagaauguuucugcacagaaagauggagaaaaaucuagaguaaaagucaaagugcgagucaacacccauggcauuuucaccaucucuacggcaucuaugguggagaaagucccaacugaggagaaugaaaugucuucugaagcugacauggagugucugaaucagagaccaccagaaaacccagacacugauaaaaauguccagcaagacaacagugaagcuggaacacagccccagguacaaacugaugcucaacaaaccucacagucucccccuucaccugaacuuaccucagaagaaaacaaaaucccagaugcugacaaagcaaaugaaaaaaaaguugaccagccuccagaagcuaaaaagcccaaaauaaagguggugaauguugagcugccuauugaagccaacuuggucuggcaguuagggaaagaccuucuuaacauguauauugagacagaggguaagaugauaaugcaagauaaauuggaaaaagaaaggaaugaugcuaaaaaugcaguugaggaauauguguaugaguucagagacaagcuguguggaccauaugaaaaauuuauaugugagcaggaucaucaaaauuuuuugagacuccucacagaaacugaagacuggcuguaugaagaaggagaggaccaagcuaaacaagcauauguugacaaguuggaagaauuaaugaaaauuggcacuccaguuaaaguucgguuucaggaagcugaagaacggccaaaaauguuugaagaacuaggacagaggcugcagcauuaugccaagauagcagcugacuucagaaauaaggaugagaaauacaaccauauugaugagucugaaaugaaaaaaguggagaagucuguuaaugaagugauggaauggaugaauaaugucaugaaugcucaggcuaaaaagagucuugaucaggauccaguuguacgugcucaggaaauuaaaacaaaaaucaaggaauugaacaacacaugugaacccguuguaacacaaccgaaaccaaaaauugaaucacccaaacuggaaagaacuccaaauggcccaaauauugauaaaaaggaagaagauuuagaagacaaaaacaauuuuggugcugaaccuccacaucagaauggugaauguuacccuaaugagaaaaauucuguuaauauggacuuggacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6193 - RNA, 3276 nt, Artificial Sequence
  mRNA product Design5 comprising derived and/or modified sequence from Homo sapiens__NP_006380.1 __HsHYOU1 (wt)
gggagagucccgcagucggcguccagcggcucugcuuguucgugugugugucguugcaggccuuauucaagcuuaccauggcagacaaaguuaggaggcagaggccgaggaggcgagucuguugggccuugguggcugugcucuuggcagaccuguuggcacugagugauacacuggcagugaugucuguggaccugggcagugaguccaugaagguggccauugucaaaccuggagugcccauggaaauugucuugaauaaggaaucucggaggaaaacaccggugaucgugacccugaaagaaaaugaaagauucuuuggagacagugcagcaagcauggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgcagcugcaguucucaccugaggaaguguugggcaugguucucaauuauucucguucucuagcugaagauuuugcagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccagaauaucauguucuaugacaugggcucaggcagcaccguaugcaccauugugaccuaccagauggugaagacuaaggaagcugggaugcagccacagcugcagauccggggaguaggauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacagauugaaggccugauggaugauguggacuucaaggcaaaagugacucguguggaauuugaggaguugugugcagacuuguuugagcgggugccugggccuguacagcaggcccuccagagugccgaaaugagucuggaugagauugagcaggucauccugguggguggggccacucggguccccagaguucaggaggugcugcugaaggccgugggcaaggaggagcuggggaagaacaucaaugcagaugaagcagccgccaugggggcaguguaccaggcagcugcgcucagcaaagccuuuaaagugaagccauuugucguccgagaugcaguggucuaccccauccugguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggguauuuggcucccagaaucugaccacagugaagcuaaaaggggugggugacagcuucaagaaguauccugacuacgaguccaagggcaucaaggcucacuucaaccuggaugagaguggcgugcucagucuagacaggguggagucuguauuugagacacugguagaggacagcgcagaagaggaaucuacucucaccaaacuuggcaacaccauuuccagccuguuuggaggcgguaccacaccagaugccaaggagaaugguacugauacuguccaggaggaagaggagagcccugcagaggggagcaaggacgagccuggggagcaggucgagcucaaggaggaagcugaggccccaguggaggauggcucucagcccccacccccugaaccuaagggagaugcaaccccugagggagaaaaggccacagaaaaagaaaauggggacaagucugaggcccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaacuucaggacuugacacuccgagaccuggagaagcaggaacgggaaaaagcugccaacagcuuggaagcauucauauuugagacccaggacaagcuguaccagcccgaguaccaggaaguguccacagaggagcagcgugaggagaucucugggaagcucagcgccgcauccaccuggcuggaggaugaggguguuggagccaccacagugauguugaaggagaagcuggcugagcugaggaagcugugccaagggcuguuuuuucggguagaggagcgcaagaaguggcccgaacggcugucugcccucgauaaucuccucaaccauuccagcauguuccucaagggggcccggcucaucccagagauggaccagaucuucacugagguggagaugacaacguuagagaaagucaucaaugagaccugggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggccagacugaagaugcagagcccauuucagaaccugagaaaguagagacuggauccgagccaggagacacugagccuuuggaguuaggagguccuggagcagaaccugaacagaaagaacaaucgacaggacagaagcggccuuugaagaacgacgaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6194 - RNA, 2475 nt, Artificial Sequence
  mRNA product Design5 comprising derived and/or modified sequence from Homo sapiens__NP_005339.3 __HsHSP90AA1 (wt)
gggagagucccgcagucggcguccagcggcucugcuuguucgugugugugucguugcaggccuuauucaagcuuaccaugccugaggaaacccagacccaagaccaaccgauggaggaggaggagguugagacguucgccuuucaggcagaaauugcccaguugaugucauugaucaucaauacuuucuacucgaacaaagagaucuuucugagagagcucauuucaaauucaucagaugcauuggacaaaauccgguaugagagcuugacagaucccaguaaauuagacucugggaaagagcugcauauuaaccuuauaccgaacaaacaagaucgaacucucacuauuguggauacuggaauuggaaugaccaaggcugacuugaucaauaaccuugguacuaucgccaagucugggaccaaagcguucauggaagcauugcaggcuggugcagauaucucuaugauuggccaguucgguguugguuuuuauucugcuuauuugguugcugagaaaguaacugugaucaccaaacauaacgaugaugagcaguacgcuugggaguccucagcagggggaucauucacagugaggacagacacaggugaaccuaugggucguggaacaaaaguuauccuacaccugaaagaagaccaaacugaguacuuggaggaacgaagaauaaaggagauugugaagaaacauucucaguuuauuggauaucccauuacucuuuuuguggagaaggaacgugauaaagaaguaagcgaugaugaggcugaagaaaaggaagacaaagaagaagaaaaagaaaaagaagagaaagagucggaagacaaaccugaaauugaagauguugguucugaugaggaagaagaaaagaaggauggugacaagaagaagaagaagaagauuaaggaaaaguacaucgaucaagaagaacucaacaaaacaaagcccaucuggaccagaaaucccgacgauauuacuaaugaggaguacggagaguucuauaagagcuugaccaaugacugggaagaucacuuggcagugaagcauuuuucaguugaaggacaguuggaguucagagcccuucuauuugucccacgacgugcuccuuuugaucuguuugaaaacagaaagaaaaagaacaacaucaaauuguauguacgcagaguuuucaucauggauaacugugaggagcuaaucccugaauaucugaacuucauuagaggggugguagacucggaggaucucccucuaaacauaucccgugagauguugcaacaaagcaaaauuuugaaaguuaucaggaagaauuuggucaaaaaaugcuuagaacucuuuacugaacuggcggaagauaaagagaacuacaagaaauucuaugagcaguucucuaaaaacauaaagcucggaauacacgaagacucucaaaaucggaagaagcucucagagcuguuaagguacuacacaucugccucuggugaugagaugguuucucucaaggacuacugcaccagaaugaaggagaaccagaaacauaucuauuauaucacaggugagaccaaggaccagguagcuaacucagccuuuguggaacgucuucggaaacauggcuuagaagugaucuauaugauugagcccauugaugaguacuguguccaacagcugaaggaauuugaggggaagacuuuagugucagucaccaaagaaggccuggaacuuccagaggaugaagaagagaaaaagaagcaggaagagaaaaaaacaaaguuugagaaccucugcaaaaucaugaaagacauauuggagaaaaaaguugaaaaggugguugugucaaaccgauuggugacaucuccaugcuguauugucacaagcacauauggcuggacagcaaacauggagagaaucaugaaagcucaagcccuaagagacaacucaacaauggguuacauggcagcaaagaaacaccuggagauaaacccugaccauuccauuauugagaccuuaaggcaaaaggcagaggcugauaagaacgacaagucugugaaggaucuggucaucuugcuuuaugaaacugcgcuccugucuucuggcuucagucuggaagauccccagacacaugcuaacaggaucuacaggaugaucaaacuuggucuggguauugaugaagaugacccuacugcugaugauaccagugcugcuguaacugaagaaaugccaccccuugaaggagaugacgacacaucacgcauggaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6195 - RNA, 615 nt, Artificial Sequence
  mRNA product Design5 comprising derived and/or modified sequence from Homo sapiens__NG_005218__HsHSP90AA3P (wt)
gggagagucccgcagucggcguccagcggcucugcuuguucgugugugugucguugcaggccuuauucaagcuuaccauggauuccaguaaauuagacucugggaaagggcugcauauuaaccuuguaccaaacaaacaaaaucaaacccucacuauuguggacacuagaauuggaaugaccaagacugacuugaucaauaaccucgguacugucaccaagucugggaccaaagcauucauggaagcauugcaggcugaugcagauaucucuaugauuggccauuucgggguugguuuuuauucugcuuauuugguugccaagaaaguaacugugaucagcaaacauaacaaugaugagcaguacaccugggaguccucagcagggggaucauucacagugaggacagacgagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6196 - RNA, 2451 nt, Artificial Sequence
  mRNA product Design5 comprising derived and/or modified sequence from Homo sapiens__NP_031381.2__HsHSP90AB1 (wt)
gggagagucccgcagucggcguccagcggcucugcuuguucgugugugugucguugcaggccuuauucaagcuuaccaugccugaggaagugcaccauggagaggaggagguggagacuuuugccuuucaggcagaaauugcccaacucaugucccucaucaucaauaccuucuauuccaacaaggagauuuuccuucgggaguugaucucuaaugcuucugaugccuuggacaagauucgcuaugagagccugacagacccuucgaaguuggacagugguaaagagcugaaaauugacaucauccccaacccucaggaacguacccugacuuugguagacacaggcauuggcaugaccaaagcugaucucauaaauaauuugggaaccauugccaagucugguacuaaagcauucauggaggcucugcaggcuggugcagacaucuccaugauugggcaguuugguguuggcuuuuauucugccuacuugguggcagagaaagugguugugaucacaaagcacaacgaugaugaacaguaugcuugggagucuucugcuggagguuccuucacugugcgugcugaccauggugagcccauuggcagggguaccaaagugauccuccaucuuaaagaagaucagacagaguaccuagaagagaggcgggucaaagaaguagugaagaagcauucucaguucauaggcuaucccaucacccuuuauuuggagaaggaacgagagaaggaaauuagugaugaugaggcagaggaagagaaaggugagaaagaagaggaagauaaagaugaugaagaaaaacccaagaucgaagauguggguucagaugaggaggaugacagcgguaaggauaagaagaagaaaacuaagaagaucaaagagaaauacauugaucaggaagaacuaaacaagaccaagccuauuuggaccagaaacccugaugacaucacccaagaggaguauggagaguucuacaagagccucacuaaugacugggaagaccacuuggcagucaagcacuuuucuguagaaggucaguuggaguucagggcauugcuauuuauuccucgucgggcucccuuugaccuuuuugagaacaagaagaaaaagaacaacaucaaacucuauguccgccguguguucaucauggacagcugugaugaguugauaccagaguaucucaauuuuauccguggugugguugacucugaggaucugccccugaacaucucccgagaaaugcuccagcagagcaaaaucuugaaagucauucgcaaaaacauuguuaagaagugccuugagcuguucucugagcuggcagaagacaaggagaauuacaagaaauucuaugaggcauucucuaaaaaucucaagcucggaauccacgaagacuccacuaaccgccgccgccugucugagcugcugcgcuaucauaccucccagucuggagaugagaugacaucucugucagaguauguuucucgcaugaaggagacacagaaguccaucuauuacaucacuggugagagcaaagagcaggucgccaacucagcuuuuguggagcgagugcggaaacggggcuucgaggugguauauaugaccgagcccauugacgaguacugugugcagcagcucaaggaauuugaugggaaaagccuggucucaguuaccaaggagggucuggagcugccugaggaugaggaggagaagaagaagauggaagagagcaaggcaaaguuugagaaccucugcaagcucaugaaagaaaucuuagauaagaagguugagaaggugacaaucuccaauagacuugugucuucaccuugcugcauugugaccagcaccuacggcuggacagccaauauggagcggaucaugaaagcccaggcacuucgggacaacuccaccaugggcuauaugauggccaaaaagcaccuggagaucaacccugaccaccccauuguggagacgcugcggcagaaggcugaggccgacaagaaugauaaggcaguuaaggaccugguggugcugcuguuugaaaccgcccugcuaucuucuggcuuuucccuugaggauccccagacccacuccaaccgcaucuaucgcaugaucaagcuaggucuagguauugaugaagaugaaguggcagcagaggaacccaaugcugcaguuccugaugagauccccccucucgagggcgaugaggaugcgucucgcauggaagaagucgauuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6197 - RNA, 2688 nt, Artificial Sequence
  mRNA product Design5 comprising derived and/or modified sequence from Homo sapiens__NP_003290.1__HsHSP90B1 (wt)
gggagagucccgcagucggcguccagcggcucugcuuguucgugugugugucguugcaggccuuauucaagcuuaccaugagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcauucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcugguucguaaaacgcuggacaugaucaagaagauugcugaugauaaauacaaugauacuuuuuggaaagaauuugguaccaacaucaagcugggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagaacccgaagaagaaccugaagagacagcagaagacacaacagaagacacagagcaagacgaagaugaagaaauggaugugggaacagaugaagaagaagaaacagcaaaggaaucuacagcugaaaaagaugaauuguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6198 - RNA, 2391 nt, Artificial Sequence
  mRNA product Design5 comprising derived and/or modified sequence from Homo sapiens__NP_057376.2__HsTRAP1 (wt)
gggagagucccgcagucggcguccagcggcucugcuuguucgugugugugucguugcaggccuuauucaagcuuaccauggcgcgcgagcugcgggcgcugcugcuguggggccgccgccugcggccuuugcugcgggcgccggcgcuggcggccgugccgggaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguuccacuuccaaacaugaguuccaggccgagacaaagaagcuguuggacauuguugcccggucccuguacucagaaaaagagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccaggauacugguaucgggaugacacaggaagaacugguguccaaccuggggacgauugccagaucggggucaaaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugguucuggaguguuugaaaucgccgaagcaucgggaguuagaaccgggacaaaaaucaucauccaccugaaauccgacugcaaggaguuuuccagcgaggcccgggugcgagaugugguaacgaaguacagcaacuucgucagcuuccccuuguacuugaauggaaggcggaugaacaccuugcaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacaugaaaccguccauguuugaugugagccgggagcugggcuccagcguugcacuguacagccgcaaaguccucauccagaccaaggccacggacauccugcccaaguggcugcgcuucauccgaggugugguggacagugaggacauuccccugaaccucagccgggagcugcugcaggagagcgcacucaucaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagagguucucuucugcuuugagcaguuugaugagcucacccugcugcaccuucgugaguuugacaagaagaagcugaucucuguggagacggacauagucguggaucacuacaaggaggagaaguuugaggacagguccccagccgccgagugccuaucagagaaggagacggaggagcucauggccuggaugagaaaugugcuggggucgcgugucaccaacgugaaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggcacgcgcucaucaagaagcugaaucagcugcgcgcaagcgagccuggccuggcucagcugcugguggaucagauauacgagaacgccaugauugcugcuggacuuguugacgacccuagggccauggugggccgcuugaaugagcugcuugucaaggcccuggagcgacacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6199 - RNA, 738 nt, Artificial Sequence
  mRNA product Design5 comprising derived and/or modified sequence from Homo sapiens__NP_000609.1__HsIGF1 (wt)
gggagagucccgcagucggcguccagcggcucugcuuguucgugugugugucguugcaggccuuauucaagcuuaccaugggaaaaaucagcagucuuccaacccaauuauuuaagugcugcuuuugugauuucuugaaggugaagaugcacaccauguccuccucgcaucucuucuaccuggcgcugugccugcucaccuucaccagcucugccacggcuggaccggagacgcucugcggggcugagcugguggaugcucugcaguucguguguggagacaggggcuuuuauuucaacaagcccacaggguauggcuccagcagucggagggcgccucagacaggcaucguggaugagugcugcuuccggagcugugaucuaaggaggcuggagauguauugcgcaccccucaagccugccaagucagcucgcucuguccgugcccagcgccacaccgacaugcccaagacccagaaggaaguacauuugaagaacgcaaguagagggagugcaggaaacaagaacuacaggauguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6200 - RNA, 915 nt, Artificial Sequence
  mRNA product Design5 comprising derived and/or modified sequence from Homo sapiens__NP_000591.1__HsIL6 (wt)
gggagagucccgcagucggcguccagcggcucugcuuguucgugugugugucguugcaggccuuauucaagcuuaccaugaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcugugcagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucugcggcaaauguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6201 - RNA, 1557 nt, Artificial Sequence
  mRNA product Design5 comprising derived and/or modified sequence from Homo sapiens__NP_002183.1__HsINHBA (wt)
gggagagucccgcagucggcguccagcggcucugcuuguucgugugugugucguugcaggccuuauucaagcuuaccaugcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcugcaugugggcaaagucggggagaacggguauguggagauagaggaugacauuggaaggagggcagaaaugaaugaacuuauggagcagaccucggagaucaucacguuugccgagucaggaacagccaggaagacgcugcacuucgagauuuccaaggaaggcagugaccugucagugguggagcgugcagaagucuggcuguuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaaaagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6202 - RNA, 3735 nt, Artificial Sequence
  mRNA product Design5 comprising derived and/or modified sequence from Homo sapiens__NP_000623.2__HsITGAM (wt)
gggagagucccgcagucggcguccagcggcucugcuuguucgugugugugucguugcaggccuuauucaagcuuaccauggcucucagaguccuucuguuaacagccuugaccuuaugucauggguucaacuuggacacugaaaacgcaaugaccuuccaagagaacgcaaggggcuucgggcagagcgugguccagcuucagggauccaggguggugguuggagccccccaggagauaguggcugccaaccaaaggggcagccucuaccagugcgacuacagcacaggcucaugcgagcccauccgccugcagguccccguggaggccgugaacaugucccugggccugucccuggcagccaccaccagccccccucagcugcuggccuguggucccaccgugcaccagacuugcagugagaacacguaugugaaagggcucugcuuccuguuuggauccaaccuacggcagcagccccagaaguucccagaggcccuccgaggguguccucaagaggauagugacauugccuucuugauugauggcucugguagcaucaucccacaugacuuucggcggaugaaggaguuugucucaacugugauggagcaauuaaaaaaguccaaaaccuuguucucuuugaugcaguacucugaagaguuccggauucacuuuaccuucaaagaguuccagaacaacccuaacccaagaucacuggugaagccaauaacgcagcugcuugggcggacacacacggccacgggcauccgcaaagugguacgagagcuguuuaacaucaccaacggagcccgaaagaaugccuuuaagauccuaguugucaucacggauggagaaaaguuuggcgaucccuugggauaugaggaugucaucccugaggcagacagagagggagucauucgcuacgucauuggggugggagaugccuuccgcagugagaaaucccgccaagagcuuaauaccaucgcauccaagccgccucgugaucacguguuccaggugaauaacuuugaggcucugaagaccauucagaaccagcuucgggagaagaucuuugcgaucgaggguacucagacaggaaguagcagcuccuuugagcaugagaugucucaggaaggcuucagcgcugccaucaccucuaauggccccuugcugagcacuguggggagcuaugacugggcugguggagucuuucuauauacaucaaaggagaaaagcaccuucaucaacaugaccagaguggauucagacaugaaugaugcuuacuuggguuaugcugccgccaucaucuuacggaaccgggugcaaagccugguucugggggcaccucgauaucagcacaucggccugguagcgauguucaggcagaacacuggcaugugggaguccaacgcuaaugucaagggcacccagaucggcgccuacuucggggccucccucugcuccguggacguggacagcaacggcagcaccgaccugguccucaucggggccccccauuacuacgagcagacccgagggggccagguguccgugugccccuugcccagggggagggcucgguggcagugugaugcuguucucuacggggagcagggccaacccuggggccgcuuuggggcagcccuaacagugcugggggacguaaauggggacaagcugacggacguggccauuggggccccaggagaggaggacaaccggggugcuguuuaccuguuucacggaaccucaggaucuggcaucagccccucccauagccagcggauagcaggcuccaagcucucucccaggcuccaguauuuuggucagucacugagugggggccaggaccucacaauggauggacugguagaccugacuguaggagcccaggggcacgugcugcugcucaggucccagccaguacugagagucaaggcaaucauggaguucaaucccagggaaguggcaaggaauguauuugaguguaaugaucagguggugaaaggcaaggaagccggagaggucagagucugccuccauguccagaaaagcacacgggaucggcuaagagaaggacagauccagaguguugugacuuaugaccuggcucuggacuccggccgcccacauucccgcgccgucuucaaugagacaaagaacagcacacgcagacagacacaggucuuggggcugacccagacuugugagacccugaaacuacaguugccgaauugcaucgaggacccagugagccccauugugcugcgccugaacuucucucuggugggaacgccauugucugcuuucgggaaccuccggccagugcuggcggaggaugcucagagacucuucacagccuuguuucccuuugagaagaauuguggcaaugacaacaucugccaggaugaccucagcaucaccuucaguuucaugagccuggacugccucguggugggugggccccgggaguucaacgugacagugacugugagaaaugauggugaggacuccuacaggacacaggucaccuucuucuucccgcuugaccuguccuaccggaagguguccacgcuccagaaccagcgcucacagcgauccuggcgccuggccugugagucugccuccuccaccgaagugucuggggccuugaaaagcaccagcugcagcauaaaccaccccaucuucccggaaaacucagaggucaccuuuaauaucacguuugauguagacucuaaggcuucccuuggaaacaaacugcuccucaaggccaaugugaccagugagaacaacaugcccagaaccaacaaaaccgaguuccaacuggagcugccggugaaauaugcugucuacaugguggucaccagccauggggucuccacuaaauaucucaacuucacggccucagagaauaccagucgggucaugcagcaucaauaucaggucagcaaccuggggcagaggagccuccccaucagccugguguucuuggugcccguccggcugaaccagacugucauaugggaccgcccccaggucaccuucuccgagaaccucucgaguacgugccacaccaaggagcgcuugcccucucacuccgacuuucuggcugagcuucggaaggcccccguggugaacugcuccaucgcugucugccagagaauccagugugacaucccguucuuuggcauccaggaagaguucaaugcuacccucaaaggcaaccucucguuugacugguacaucaagaccucgcauaaccaccuccugaucgugagcacagcugagaucuuguuuaacgauuccguguucacccugcugccgggacagggggcguuugugaggucccagacggagaccaaaguggagccguucgagguccccaacccccugccgcucaucgugggcagcucugucgggggacugcugcuccuggcccucaucaccgccgcgcuguacaagcucggcuucuucaagcggcaauacaaggacaugaugagugaagggggucccccgggggccgaaccccaguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6203 - RNA, 1680 nt, Artificial Sequence
  mRNA product Design5 comprising derived and/or modified sequence from Homo sapiens__NP_002415.1__HsMMP8 (wt)
gggagagucccgcagucggcguccagcggcucugcuuguucgugugugugucguugcaggccuuauucaagcuuaccauguucucccugaagacgcuuccauuucugcucuuacuccaugugcagauuuccaaggccuuuccuguaucuucuaaagagaaaaauacaaaaacuguucaggacuaccuggaaaaguucuaccaauuaccaagcaaccaguaucagucuacaaggaagaauggcacuaaugugaucguugaaaagcugaaagaaaugcagcgauuuuuuggguugaaugugacggggaagccaaaugaggaaacucuggacaugaugaaaaagccucgcuguggagugccugacaguggugguuuuauguuaaccccaggaaaccccaagugggaacgcacuaacuugaccuacaggauucgaaacuauaccccacagcugucagaggcugagguagaaagagcuaucaaggaugccuuugaacucuggaguguugcaucaccucucaucuucaccaggaucucacagggagaggcagauaucaacauugcuuuuuaccaaagagaucacggugacaauucuccauuugauggacccaauggaauccuugcucaugccuuucagccaggccaagguauuggaggagaugcucauuuugaugccgaagaaacauggaccaacaccuccgcaaauuacaacuuguuucuuguugcugcucaugaauuuggccauucuuuggggcucgcucacuccucugacccuggugccuugauguaucccaacuaugcuuucagggaaaccagcaacuacucacucccucaagaugacaucgauggcauucaggccaucuauggacuuucaagcaacccuauccaaccuacuggaccaagcacacccaaacccugugaccccaguuugacauuugaugcuaucaccacacuccguggagaaauacuuuucuuuaaagacagguacuucuggagaaggcauccucagcuacaaagagucgaaaugaauuuuauuucucuauucuggccaucccuuccaacugguauacaggcugcuuaugaagauuuugacagagaccucauuuuccuauuuaaaggcaaccaauacugggcucugaguggcuaugauauucugcaagguuaucccaaggauauaucaaacuauggcuuccccagcagcguccaagcaauugacgcagcuguuuucuacagaaguaaaacauacuucuuuguaaaugaccaauucuggagauaugauaaccaaagacaauucauggagccagguuaucccaaaagcauaucaggugccuuuccaggaauagagaguaaaguugaugcaguuuuccagcaagaacauuucuuccaugucuucaguggaccaagauauuacgcauuugaucuuauugcucagagaguuaccagaguugcaagaggcaauaaauggcuuaacuguagauauggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6204 - RNA, 2400 nt, Artificial Sequence
  mRNA product Design5 comprising derived and/or modified sequence from Homo sapiens__NP_004985.2__HsMMP9 (wt)
gggagagucccgcagucggcguccagcggcucugcuuguucgugugugugucguugcaggccuuauucaagcuuaccaugagccucuggcagccccugguccuggugcuccuggugcugggcugcugcuuugcugcccccagacagcgccaguccacccuugugcuguucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcuguucggcuucugcccgacccgagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuguucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6205 - RNA, 1344 nt, Artificial Sequence
  mRNA product Design5 comprising derived and/or modified sequence from Homo sapiens__NP_001286.1__HsCCR1 (wt)
gggagagucccgcagucggcguccagcggcucugcuuguucgugugugugucguugcaggccuuauucaagcuuaccauggaaacuccaaacaccacagaggacuaugacacgaccacagaguuugacuauggggaugcaacuccgugccagaaggugaacgagagggccuuuggggcccaacugcugcccccucuguacuccuugguauuugucauuggccugguuggaaacauccuggugguccugguccuugugcaauacaagaggcuaaaaaacaugaccagcaucuaccuccugaaccuggccauuucugaccugcuguuccuguucacgcuucccuucuggaucgacuacaaguugaaggaugacuggguuuuuggugaugccauguguaagauccucucuggguuuuauuacacaggcuuguacagcgagaucuuuuucaucauccugcugacgauugacagguaccuggccaucguccacgccguguuugccuugcgggcacggaccgucacuuuuggugucaucaccagcaucaucauuugggcccuggccaucuuggcuuccaugccaggcuuauacuuuuccaagacccaaugggaguucacucaccacaccuguagccuucacuuuccucacgaaagccuacgagaguggaagcuguuucaggcucugaaacugaaccucuuugggcugguauugccuuuguuggucaugaucaucugcuacacagggauuauaaagauucugcuaagacgaccaaaugagaagaaauccaaagcuguccguuugauuuuugucaucaugaucaucuuuuuucucuuuuggacccccuacaauuugacuauacuuauuucuguuuuccaagacuuccuguucacccaugagugugagcagagcagacauuuggaccuggcugugcaagugacggaggugaucgccuacacgcacugcugugucaacccagugaucuacgccuucguuggugagagguuccggaaguaccugcggcaguuguuccacaggcguguggcugugcaccugguuaaauggcuccccuuccucuccguggacaggcuggagagggucagcuccacaucucccuccacaggggagcaugaacucucugcuggguucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6206 - RNA, 1002 nt, Artificial Sequence
  mRNA product Design5 comprising derived and/or modified sequence from Homo sapiens__NP_002599.1__HsPDGFB (wt)
gggagagucccgcagucggcguccagcggcucugcuuguucgugugugugucguugcaggccuuauucaagcuuaccaugaaucgcugcugggcgcuguuccugucucucugcugcuaccugcgucuggucagcgccgagggggaccccauucccgaggagcuuuaugagaugcugagugaccacucgauccgcuccuuugaugaucuccaacgccugcugcacggagaccccggagaggaagauggggccgaguuggaccugaacaugacccgcucccacucuggaggcgagcuggagagcuuggcucguggaagaaggagccuggguucccugaccauugcugagccggccaugaucgccgagugcaagacgcgcaccgagguguucgagaucucccggcgccucauagaccgcaccaacgccaacuuccugguguggccgcccuguguggaggugcagcgcugcuccggcugcugcaacaaccgcaacgugcagugccgccccacccaggugcagcugcgaccuguccaggugagaaagaucgagauugugcggaagaagccaaucuuuaagaaggccacggugacgcuggaagaccaccuggcaugcaagugugagacaguggcagcugcacggccugugacccgaagcccgggggguucccaggagcagcgagccaaaacgccccaaacucgggugaccauucggacggugcgaguccgccggccccccaagggcaagcaccggaaauucaagcacacgcaugacaagacggcacugaaggagacccuuggagccuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6207 - RNA, 1371 nt, Artificial Sequence
  mRNA product Design5 comprising derived and/or modified sequence from Homo sapiens__NP_149126.1__HsPDGFD (wt)
gggagagucccgcagucggcguccagcggcucugcuuguucgugugugugucguugcaggccuuauucaagcuuaccaugcaccggcucaucuuugucuacacucuaaucugcgcaaacuuuugcagcugucgggacacuucugcaaccccgcagagcgcauccaucaaagcauugcgcaacgccaaccucaggcgagaugacuuguaccgaagagaugagaccauccaggugaaaggaaacggcuacgugcagaguccuagauucccgaacagcuaccccaggaaccugcuccugacauggcggcuucacucucaggagaauacacggauacagcuaguguuugacaaucaguuuggauuagaggaagcagaaaaugauaucuguagguaugauuuuguggaaguugaagauauauccgaaaccaguaccauuauuagaggacgaugguguggacacaaggaaguuccuccaaggauaaaaucaagaacgaaccaaauuaaaaucacauucaaguccgaugacuacuuuguggcuaaaccuggauucaagauuuauuauucuuugcuggaagauuuccaacccgcagcagcuucagagaccaacugggaaucugucacaagcucuauuucagggguauccuauaacucuccaucaguaacggaucccacucugauugcggaugcucuggacaaaaaaauugcagaauuugauacaguggaagaucugcucaaguacuucaauccagagucauggcaagaagaucuugagaauauguaucuggacaccccucgguaucgaggcaggucauaccaugaccggaagucaaaaguugaccuggauaggcucaaugaugaugccaagcguuacaguugcacucccaggaauuacucggucaauauaagagaagaacugaaguuggccaauguggucuucuuuccacguugccuccucgugcagcgcuguggaggaaauuguggcuguggaacugucaacuggagguccugcacaugcaauucagggaaaaccgugaaaaaguaucaugagguauuacaguuugagccuggccacaucaagaggagggguagagcuaagaccauggcucuaguugacauccaguuggaucaccaugaacgaugugauuguaucugcagcucaagaccaccucgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6208 - RNA, 954 nt, Artificial Sequence
  mRNA product Design5 comprising derived and/or modified sequence from Homo sapiens__NP_003946.3__HsSOCS3 (wt)
gggagagucccgcagucggcguccagcggcucugcuuguucgugugugugucguugcaggccuuauucaagcuuaccauggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagggccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6209 - RNA, 1449 nt, Artificial Sequence
  mRNA product Design5 comprising derived and/or modified sequence from Homo sapiens__NP_000651.3__HsTGFB1 (wt)
gggagagucccgcagucggcguccagcggcucugcuuguucgugugugugucguugcaggccuuauucaagcuuaccaugccgcccuccgggcugcggcugcugccgcugcugcuaccgcugcuguggcuacuggugcugacgccuggccggccggccgcgggacuauccaccuguaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacgaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccagaaauacagcaacaauuccuggcgauaccucagcaaccggcugcuggcacccagcgacucgccagagugguuaucuuuugaugucaccggaguugugcggcagugguugagccguggaggggaaauugagggcuuucgccuuagcgcccacugcuccugugacagcagggauaacacacugcaaguggacaucaacggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6210 - RNA, 1521 nt, Artificial Sequence
  mRNA product Design5 comprising derived and/or modified sequence from Homo sapiens__NP_003229.1__HsTGFB2 (wt)
gggagagucccgcagucggcguccagcggcucugcuuguucgugugugugucguugcaggccuuauucaagcuuaccaugcacuacugugugcugagcgcuuuucugauccugcaucuggucacggucgcgcucagccugucuaccugcagcacacucgauauggaccaguucaugcgcaagaggaucgaggcgauccgcgggcagauccugagcaagcugaagcucaccagucccccagaagacuauccugagcccgaggaaguccccccggaggugauuuccaucuacaacagcaccagggacuugcuccaggagaaggcgagccggagggcggccgccugcgagcgcgagaggagcgacgaagaguacuacgccaaggagguuuacaaaauagacaugccgcccuucuuccccuccgaaaaugccaucccgcccacuuucuacagacccuacuucagaauuguucgauuugacgucucagcaauggagaagaaugcuuccaauuuggugaaagcagaguucagagucuuucguuugcagaacccaaaagccagagugccugaacaacggauugagcuauaucagauucucaaguccaaagauuuaacaucuccaacccagcgcuacaucgacagcaaaguugugaaaacaagagcagaaggcgaauggcucuccuucgauguaacugaugcuguucaugaauggcuucaccauaaagacaggaaccugggauuuaaaauuagcuuacacugucccugcugcacuuuuguaccaucuaauaauuacaucaucccaaauaaaagugaagaacuagaagcaagauuugcagguauugauggcaccuccacauauaccaguggugaucagaaaacuauaaaguccacuaggaaaaaaaacagugggaagaccccacaucuccugcuaauguuauugcccuccuacagacuugagucacaacagaccaaccggcggaagaagcgugcuuuggaugcggccuauugcuuuagaaaugugcaggauaauugcugccuacguccacuuuacauugauuucaagagggaucuaggguggaaauggauacacgaacccaaaggguacaaugccaacuucugugcuggagcaugcccguauuuauggaguucagacacucagcacagcaggguccugagcuuauauaauaccauaaauccagaagcaucugcuucuccuugcugcgugucccaagauuuagaaccucuaaccauucucuacuacauuggcaaaacacccaagauugaacagcuuucuaauaugauuguaaagucuugcaaaugcagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6211 - RNA, 1515 nt, Artificial Sequence
  mRNA product Design5 comprising derived and/or modified sequence from Homo sapiens__NP_003230.1__HsTGFB3 (wt)
gggagagucccgcagucggcguccagcggcucugcuuguucgugugugugucguugcaggccuuauucaagcuuaccaugaagaugcacuugcaaagggcucuggugguccuggcccugcugaacuuugccacggucagccucucucuguccacuugcaccaccuuggacuucggccacaucaagaagaagaggguggaagccauuaggggacagaucuugagcaagcucaggcucaccagccccccugagccaacggugaugacccacguccccuaucagguccuggcccuuuacaacagcacccgggagcugcuggaggagaugcauggggagagggaggaaggcugcacccaggaaaacaccgagucggaauacuaugccaaagaaauccauaaauucgacaugauccaggggcuggcggagcacaacgaacuggcugucugcccuaaaggaauuaccuccaagguuuuccgcuucaauguguccucaguggagaaaaauagaaccaaccuauuccgagcagaguuccgggucuugcgggugcccaaccccagcucuaagcggaaugagcagaggaucgagcuguuccagauccuucggccagaugagcacauugccaaacagcgcuauaucgguggcaagaaucugcccacacggggcacugccgaguggcuguccuuugaugucacugacacugugcgugaguggcuguugagaagagaguccaacuuaggucuagaaaucagcauucacuguccaugucacaccuuucagcccaauggagauauccuggaaaacauucacgaggugauggaaaucaaauucaaaggcguggacaaugaggaugaccauggccguggagaucuggggcgccucaagaagcagaaggaucaccacaacccucaucuaauccucaugaugauucccccacaccggcucgacaacccgggccaggggggucagaggaagaagcgggcuuuggacaccaauuacugcuuccgcaacuuggaggagaacugcugugugcgcccccucuacauugacuuccgacaggaucugggcuggaaguggguccaugaaccuaagggcuacuaugccaacuucugcucaggcccuugcccauaccuccgcagugcagacacaacccacagcacggugcugggacuguacaacacucugaacccugaagcaucugccucgccuugcugcgugccccaggaccuggagccccugaccauccuguacuauguugggaggacccccaaaguggagcagcucuccaacaugguggugaagucuuguaaauguagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6212 - RNA, 1662 nt, Artificial Sequence
  mRNA product Design5 comprising derived and/or modified sequence from Homo sapiens__NP_001057.1__HsTNFRSF1B (wt)
gggagagucccgcagucggcguccagcggcucugcuuguucgugugugugucguugcaggccuuauucaagcuuaccauggcgcccgucgccgucugggccgcgcuggccgucggacuggagcucugggcugcggcgcacgccuugcccgcccagguggcauuuacacccuacgccccggagcccgggagcacaugccggcucagagaauacuaugaccagacagcucagaugugcugcagcaaaugcucgccgggccaacaugcaaaagucuucuguaccaagaccucggacaccgugugugacuccugugaggacagcacauacacccagcucuggaacuggguucccgagugcuugagcuguggcucccgcuguagcucugaccagguggaaacucaagccugcacucgggaacagaaccgcaucugcaccuguaggcccggcugguacugcgcgcugagcaagcaggaggggugccggcugugcgcgccgcugcgcaagugccgcccgggcuucggcguggccagaccaggaacugaaacaucagacguggugugcaagcccugugccccggggacguucuccaacacgacuucauccacggauauuugcaggccccaccagaucuguaacgugguggccaucccugggaaugcaagcauggaugcagucugcacguccacgucccccacccggaguauggccccaggggcaguacacuuaccccagccaguguccacacgaucccaacacacgcagccaacuccagaacccagcacugcuccaagcaccuccuuccugcucccaaugggccccagccccccagcugaagggagcacuggcgacuucgcucugccaguuggacugauugugggugugacagccuugggucuacuaauaauaggaguggugaacugugucaucaugacccaggugaaaaagaagcccuugugccugcagagagaagccaaggugccucacuugccugccgauaaggcccgggguacacagggccccgagcagcagcaccuccugaucacagcgccgagcuccagcagcagcucccuggagagcucggccagugcguuggacagaagggcgcccacucggaaccagccacaggcaccaggcguggaggccaguggggccggggaggcccgggccagcaccgggagcucagauucuuccccugguggccaugggacccaggucaaugucaccuguaucgugaacgucuguagcagcucugaccacagcucacagugcuccucccaagccagcuccacaaugggagacacagauuccagccccucggaguccccgaaggacgagcagguccccuucuccaaggaggaaugugccuuucggucacagcuggagacgccagagacccugcuggggagcaccgaagagaagccccugccccuuggagugccugaugcugggaugaagcccaguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6213 - RNA, 1341 nt, Artificial Sequence
  mRNA product Design5 comprising derived and/or modified sequence from Homo sapiens__NP_004460.1__HsVEGFD (wt)
gggagagucccgcagucggcguccagcggcucugcuuguucgugugugugucguugcaggccuuauucaagcuuaccauguacagagaguggguaguggugaauguuuucaugauguuguacguccagcuggugcagggcuccaguaaugaacauggaccagugaagcgaucaucucaguccacauuggaacgaucugaacagcagaucagggcugcuucuaguuuggaggaacuacuucgaauuacucacucugaggacuggaagcuguggagaugcaggcugaggcucaaaaguuuuaccaguauggacucucgcucagcaucccaucgguccacuagguuugcggcaacuuucuaugacauugaaacacuaaaaguuauagaugaagaauggcaaagaacucagugcagcccuagagaaacgugcguggagguggccagugagcuggggaagaguaccaacacauucuucaagcccccuugugugaacguguuccgaugugguggcuguugcaaugaagagagccuuaucuguaugaacaccagcaccucguacauuuccaaacagcucuuugagauaucagugccuuugacaucaguaccugaauuagugccuguuaaaguugccaaucauacagguuguaagugcuugccaacagccccccgccauccauacucaauuaucagaagauccauccagaucccugaagaagaucgcuguucccauuccaagaaacucuguccuauugacaugcuaugggauagcaacaaauguaaauguguuuugcaggaggaaaauccacuugcuggaacagaagaccacucucaucuccaggaaccagcucucugugggccacacaugauguuugacgaagaucguugcgagugugucuguaaaacaccaugucccaaagaucuaauccagcaccccaaaaacugcaguugcuuugagugcaaagaaagucuggagaccugcugccagaagcacaagcuauuucacccagacaccuguagcugugaggacagaugccccuuucauaccagaccaugugcaaguggcaaaacagcaugugcaaagcauugccgcuuuccaaaggagaaaagggcugcccaggggccccacagccgaaagaauccuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6214 - RNA, 906 nt, Artificial Sequence
  mRNA product Design5 comprising derived and/or modified sequence from Homo sapiens__NP_061986.1__HsFGF21 (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6215 - RNA, 906 nt, Artificial Sequence
  mRNA product Design5 comprising derived and/or modified sequence from Homo sapiens__NP_061986.1__HsFGF21 (wt) R5987
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6216 - RNA, 1686 nt, Artificial Sequence
  mRNA product Design5 comprising derived and/or modified sequence from Homo sapiens__NP_002412.1__HsMMP1 (wt)
gggagagucccgcagucggcguccagcggcucugcuuguucgugugugugucguugcaggccuuauucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaauucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6217 - RNA, 1686 nt, Artificial Sequence
  mRNA product Design5 comprising derived and/or modified sequence from Homo sapiens__NP_002412.1__HsMMP1 (wt)
gggagagucccgcagucggcguccagcggcucugcuuguucgugugugugucguugcaggccuuauucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaguucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6218 - RNA, 1446 nt, Artificial Sequence
  mRNA product Design5 comprising derived and/or modified sequence from Homo sapiens__NP_002412.1__HsMMP1(1-19,100-469) (wt)
gggagagucccgcagucggcguccagcggcucugcuuguucgugugugugucguugcaggccuuauucaagcuuaccaugcacagcuuuccuccacugcugcugcugcuguucugggguguggugucucacagcuuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6219 - RNA, 3633 nt, Artificial Sequence
  mRNA product Design5 comprising derived and/or modified sequence from Clostridium histolyticum__BAA77453.1__ColG (wt)
gggagagucccgcagucggcguccagcggcucugcuuguucgugugugugucguugcaggccuuauucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6220 - RNA, 3633 nt, Artificial Sequence
  mRNA product Design5 comprising derived and/or modified sequence from Clostridium histolyticum__BAA77453.1__ColG (wt)
gggagagucccgcagucggcguccagcggcucugcuuguucgugugugugucguugcaggccuuauucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6221 - RNA, 3357 nt, Artificial Sequence
  mRNA product Design5 comprising derived and/or modified sequence from Clostridium histolyticum__BAA77453.1__HsALB(1-18)_ColG(111-1118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6222 - RNA, 3357 nt, Artificial Sequence
  mRNA product Design5 comprising derived and/or modified sequence from Clostridium histolyticum__BAA77453.1__HsALB(1-18)_ColG(111-1118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6223 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6224 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6225 - RNA, 3381 nt, Artificial Sequence
  mRNA product Design5 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6226 - RNA, 3381 nt, Artificial Sequence
  mRNA product Design5 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6227 - RNA, 3342 nt, Artificial Sequence
  mRNA product Design5 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6228 - RNA, 3342 nt, Artificial Sequence
  mRNA product Design5 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6229 - RNA, 3276 nt, Artificial Sequence
  mRNA product Design5 comprising derived and/or modified sequence from Clostridium histolyticum__BAA34542.1__HsALB(1-18)_ColH(41-1021) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6230 - RNA, 3276 nt, Artificial Sequence
  mRNA product Design5 comprising derived and/or modified sequence from Clostridium histolyticum__BAA34542.1__HsALB(1-18)_ColH(41-1021) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6231 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6232 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6233 - RNA, 852 nt, Artificial Sequence
  mRNA product Design5 comprising derived and/or modified sequence from Homo sapiens__NP_001133.1__HsAMELX (wt)
gggagagucccgcagucggcguccagcggcucugcuuguucgugugugugucguugcaggccuuauucaagcuuaccauggggaccuggauuuuauuugccugccuccugggagcagcuuuugccaugccucuaccaccucauccugggcacccugguuauaucaacuucagcuaugaggugcuuaccccuuugaagugguaccagagcauaaggccaccguacccuuccuaugguuacgagcccauggguggauggcugcaccaccaaaucauccccgugcugucccaacagcaccccccgacucacacccugcagccucaucaccacaucccaguggugccagcucagcagcccgugaucccccagcaaccaaugaugcccguuccuggccaacacuccaugacuccaauccaacaccaccagccaaaccucccuccgcccgcccagcagcccuaccagccccagccuguucagccacagccucaccagcccaugcagccccagccaccugugcaccccaugcagccccugccgccacagccaccucugccuccgauguuccccaugcagccccugccucccaugcuuccugaucugacucuggaagcuuggccaucaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6234 - RNA, 852 nt, Artificial Sequence
  mRNA product Design5 comprising derived and/or modified sequence from Homo sapiens__NP_001133.1__HsAMELX (wt)
gggagagucccgcagucggcguccagcggcucugcuuguucgugugugugucguugcaggccuuauucaagcuuaccauggggaccuggauuuuauuugccugccuccugggagcagcuuuugccaugccucuaccaccucauccugggcacccugguuauaucaacuucagcuaugaggugcuuaccccuuugaagugguaccagagcauaaggccaccguacccuuccuaugguuacgagcccauggguggauggcugcaccaccaaaucauccccgugcugucccaacagcaccccccgacucacacccugcagccucaucaccacaucccaguggugccagcucagcagcccgugaucccccagcaaccaaugaugcccguuccuggccaacacuccaugacuccaauccaacaccaccagccaaaccucccuccgcccgcccagcagcccuaccagccccagccuguucagccacagccucaccagcccaugcagccccagccaccugugcaccccaugcagccccugccgccacagccaccucugccuccgauguuccccaugcagccccugccucccaugcuuccugaucugacucuggaagcauggccaucaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6235 - RNA, 411 nt, Artificial Sequence
  mRNA product Design5 comprising derived and/or modified sequence from Homo sapiens__NP_001133.1__HsAMELX-TRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccuuugaagugguaccagagcauaaggccaccguacccuuccuaugguuacgagcccauggguggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6236 - RNA, 444 nt, Artificial Sequence
  mRNA product Design5 comprising derived and/or modified sequence from Homo sapiens__NP_001133.1__HsAMELX-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccuuugaagugguaccagagcauaaggccaccucccaugcuuccugaucugacucuggaagcuuggccaucaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6237 - RNA, 444 nt, Artificial Sequence
  mRNA product Design5 comprising derived and/or modified sequence from Homo sapiens__NP_001133.1__HsAMELX-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccuuugaagugguaccagagcauaaggccaccucccaugcuuccugaucugacucuggaagcauggccaucaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6238 - RNA, 483 nt, Artificial Sequence
  mRNA product Design5 comprising derived and/or modified sequence from Homo sapiens__NP_001133.1__HLA-A2-SP_HsAMELX(17-60) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccuuugaagugguaccagagcauaaggccaccguacccuuccuaugguuacgagcccauggguggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6239 - RNA, 516 nt, Artificial Sequence
  mRNA product Design5 comprising derived and/or modified sequence from Homo sapiens__NP_001133.1__HLA-A2-SP_HsAMELX(17-47,168-191) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccuuugaagugguaccagagcauaaggccaccucccaugcuuccugaucugacucuggaagcauggccaucaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6240 - RNA, 855 nt, Artificial Sequence
  mRNA product Design5 comprising derived and/or modified sequence from Homo sapiens__NP_001134.1__HsAMELY (wt)
gggagagucccgcagucggcguccagcggcucugcuuguucgugugugugucguugcaggccuuauucaagcuuaccauggggaccuggauuuuguuugccugccuugugggagcagcuuuugccaugccucuaccaccucauccugggcacccugguuauaucaacuucagcuaugaggugcucaccccuuugaagugguaccagagcaugauaagaccaccauacucuuccuaugguuacgagcccauggguggauggcugcaccaccaaaucauccccguggugucccaacagcacccccugacucacacccugcagucucaucaccacaucccaguggugccagcucagcagcccaggguccgccagcaagcacugaugccuguuccuggccagcaauccaugacuccaacccaacaccaucagccaaaccucccucugccugcccagcagcccuuccagccccagccuguucagccacagccucaccagcccaugcagccccagccaccugugcaacccaugcagccccugcugccacagccaccucugccuccaauguucccccugcggccccugccccccauacuuccugaucugcaucuggaagcuuggccagcaacagacaagaccaagcaggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6241 - RNA, 855 nt, Artificial Sequence
  mRNA product Design5 comprising derived and/or modified sequence from Homo sapiens__NP_001134.1__HsAMELY (wt)
gggagagucccgcagucggcguccagcggcucugcuuguucgugugugugucguugcaggccuuauucaagcuuaccauggggaccuggauuuuguuugccugccuugugggagcagcuuuugccaugccucuaccaccucauccugggcacccugguuauaucaacuucagcuaugaggugcucaccccuuugaagugguaccagagcaugauaagaccaccauacucuuccuaugguuacgagcccauggguggauggcugcaccaccaaaucauccccguggugucccaacagcacccccugacucacacccugcagucucaucaccacaucccaguggugccagcucagcagcccaggguccgccagcaagcacugaugccuguuccuggccagcaauccaugacuccaacccaacaccaucagccaaaccucccucugccugcccagcagcccuuccagccccagccuguucagccacagccucaccagcccaugcagccccagccaccugugcaacccaugcagccccugcugccacagccaccucugccuccaauguucccccugcggccccugccccccauacuuccugaucugcaucuggaagcauggccagcaacagacaagaccaagcaggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6242 - RNA, 414 nt, Artificial Sequence
  mRNA product Design5 comprising derived and/or modified sequence from Homo sapiens__NP_001134.1__HsAMELY-TRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcucaccccuuugaagugguaccagagcaugauaagaccaccauacucuuccuaugguuacgagcccauggguggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6243 - RNA, 447 nt, Artificial Sequence
  mRNA product Design5 comprising derived and/or modified sequence from Homo sapiens__NP_001134.1__HsAMELY-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcucaccccuuugaagugguaccagagcaugauaagaccaccccccauacuuccugaucugcaucuggaagcuuggccagcaacagacaagaccaagcaggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6244 - RNA, 447 nt, Artificial Sequence
  mRNA product Design5 comprising derived and/or modified sequence from Homo sapiens__NP_001134.1__HsAMELY-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcucaccccuuugaagugguaccagagcaugauaagaccaccccccauacuuccugaucugcaucuggaagcauggccagcaacagacaagaccaagcaggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6245 - RNA, 486 nt, Artificial Sequence
  mRNA product Design5 comprising derived and/or modified sequence from Homo sapiens__NP_001134.1__HLA-A2-SP_HsAMELY(17-61) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcucaccccuuugaagugguaccagagcaugauaagaccaccauacucuuccuaugguuacgagcccauggguggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6246 - RNA, 519 nt, Artificial Sequence
  mRNA product Design5 comprising derived and/or modified sequence from Homo sapiens__NP_001134.1__HLA-A2-SP_HsAMELY(17-48,169-192) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcucaccccuuugaagugguaccagagcaugauaagaccaccccccauacuuccugaucugcaucuggaagcauggccagcaacagacaagaccaagcaggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6247 - RNA, 846 nt, Artificial Sequence
  mRNA product Design5 comprising derived and/or modified sequence from Sus scrofa__NP_999071.1__SsAMELX-001-1 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6248 - RNA, 846 nt, Artificial Sequence
  mRNA product Design5 comprising derived and/or modified sequence from Sus scrofa__NP_999071.1__SsAMELX-001-1 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6249 - RNA, 414 nt, Artificial Sequence
  mRNA product Design5 comprising derived and/or modified sequence from Sus scrofa__NP_999071.1__SsAMELX-TRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccucugaagugguaccagaacaugauaagacauccguacacuuccuauggguacgaacccauggguggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6250 - RNA, 447 nt, Artificial Sequence
  mRNA product Design5 comprising derived and/or modified sequence from Sus scrofa__NP_999071.1__SsAMELX-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccucugaagugguaccagaacaugauaagacauccgucucugcuuccugaccugccucuggaagcuuggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6251 - RNA, 447 nt, Artificial Sequence
  mRNA product Design5 comprising derived and/or modified sequence from Sus scrofa__NP_999071.1__SsAMELX-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6252 - RNA, 486 nt, Artificial Sequence
  mRNA product Design5 comprising derived and/or modified sequence from Sus scrofa__NP_999071.1__HLA-A2-SP_SsAMEL(17-61) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccucugaagugguaccagaacaugauaagacauccguacacuuccuauggguacgaacccauggguggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6253 - RNA, 519 nt, Artificial Sequence
  mRNA product Design5 comprising derived and/or modified sequence from Sus scrofa__NP_999071.1__HLA-A2-SP_SsAMEL(17-49,167-189) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6254 - RNA, 810 nt, Artificial Sequence
  mRNA product Design5 comprising derived and/or modified sequence from Sus scrofa__P45561-2__SsAMELX-001-2 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuauauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6255 - RNA, 846 nt, Artificial Sequence
  mRNA product Design5 comprising derived and/or modified sequence from Sus scrofa__NP_998965.1__SsAMELX-001-3 (wt)
gggagagucccgcagucggcguccagcggcucugcuuguucgugugugugucguugcaggccuuauucaagcuuaccauggggaccuggauuuucuuugccugccuuuugggagcaucccuugcuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6256 - RNA, 495 nt, Artificial Sequence
  mRNA product Design5 comprising derived and/or modified sequence from Sus scrofa__K7GPB2__SsAMELX-002 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgucucugcuuccugaccugccucuggaagcuuggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6257 - RNA, 888 nt, Artificial Sequence
  mRNA product Design5 comprising derived and/or modified sequence from Sus scrofa__K7GLD0__SsAMELX-003 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggacuuauacuuggaggcuauccguauugacaggacugcauucgugcuuaccccucugaagugguaccagaacaugauaagacauccguacacuuccuaugguuacgaacccauggguggauggcugcaccaccaaaucauucccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6258 - RNA, 774 nt, Artificial Sequence
  mRNA product Design5 comprising derived and/or modified sequence from Sus scrofa__K7GPE9__SsAMELX-004 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6259 - RNA, 798 nt, Artificial Sequence
  mRNA product Design5 comprising derived and/or modified sequence from Sus scrofa__J9JIM4__SsAMELX-201 (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6260 - RNA, 3237 nt, Artificial Sequence
  mRNA product Design5 comprising derived and/or modified sequence from Homo sapiens__NP_006120.1__HsBMP1 (wt)
gggagagucccgcagucggcguccagcggcucugcuuguucgugugugugucguugcaggccuuauucaagcuuaccaugcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcggcugccuuucuuggggacauugcccuggacgaagaggaccugagggccuuccagguacagcaggcuguggaucucagacggcacacagcucguaaguccuccaucaaagcugcaguuccaggaaacacuucuacccccagcugccagagcaccaacgggcagccucagaggggagccugugggagauggagagguagaucccguagccggcgggcggcgacgucccgaccagagcguguguggcccgauggggucauccccuuugucauugggggaaacuucacugguagccagagggcagucuuccggcaggccaugaggcacugggagaagcacaccugugucaccuuccuggagcgcacugacgaggacagcuauauuguguucaccuaucgaccuugcgggugcugcuccuacgugggucgccgcggcgggggcccccaggccaucuccaucggcaagaacugugacaaguucggcauugugguccacgagcugggccacgucgucggcuucuggcacgaacacacucggccagaccgggaccgccacguuuccaucguucgugagaacauccagccagggcaggaguauaacuuccugaagauggagccucaggagguggagucccugggggagaccuaugacuucgacagcaucaugcauuacgcucggaacacauucuccaggggcaucuuccuggauaccauuguccccaaguaugaggugaacggggugaaaccucccauuggccaaaggacacggcucagcaagggggacauugcccaagcccgcaagcuuuacaagugcccagccuguggagagacccugcaagacagcacaggcaacuucuccuccccugaauaccccaauggcuacucugcucacaugcacugcguguggcgcaucucugucacacccggggagaagaucauccugaacuucacgucccuggaccuguaccgcagccgccugugcugguacgacuauguggagguccgagauggcuucuggaggaaggcgccccuccgaggccgcuucugcggguccaaacucccugagccuaucgucuccacugacagccgccucuggguugaauuccgcagcagcagcaauuggguuggaaagggcuucuuugcagucuacgaagccaucugcgggggugaugugaaaaaggacuauggccacauucaaucgcccaacuacccagacgauuaccggcccagcaaagucugcaucuggcggauccaggugucugagggcuuccacgugggccucacauuccaguccuuugagauugagcgccacgacagcugugccuacgacuaucuggaggugcgcgacgggcacagugagagcagcacccucaucgggcgcuacuguggcuaugagaagccugaugacaucaagagcacguccagccgccucuggcucaaguucgucucugacggguccauuaacaaagcgggcuuugccgucaacuuuuucaaagagguggacgagugcucucggcccaaccgcgggggcugugagcagcggugccucaacacccugggcagcuacaagugcagcugugaccccggguacgagcuggccccagacaagcgccgcugugaggcugcuuguggcggauuccucaccaagcucaacggcuccaucaccagcccgggcuggcccaaggaguacccccccaacaagaacugcaucuggcagcugguggcccccacccaguaccgcaucucccugcaguuugacuucuuugagacagagggcaaugaugugugcaaguacgacuucguggaggugcgcaguggacucacagcugacuccaagcugcauggcaaguucugugguucugagaagcccgaggucaucaccucccaguacaacaacaugcgcguggaguucaaguccgacaacaccguguccaaaaagggcuucaaggcccacuucuucucagacaaggacgagugcuccaaggauaacggcggcugccagcaggacugcgucaacacguucggcaguuaugagugccaaugccgcaguggcuucguccuccaugacaacaagcacgacugcaaagaagccggcugugaccacaaggugacauccaccagugguaccaucaccagccccaacuggccugacaaguaucccagcaagaaggagugcacgugggccaucuccagcacccccgggcaccgggucaagcugaccuucauggagauggacaucgagucccagccugagugugccuacgaccaccuagagguguucgacgggcgagacgccaaggcccccguccucggccgcuucugugggagcaagaagcccgagcccguccuggccacaggcagccgcauguuccugcgcuucuacucagauaacucgguccagcgaaagggcuuccaggccucccacgccacagagugcgggggccagguacgggcagacgugaagaccaaggaccuuuacucccacgcccaguuuggcgacaacaacuacccuggggguguggacugugagugggucauuguggccgaggaaggcuacggcguggagcucguguuccagaccuuugagguggaggaggagaccgacugcggcuaugacuacauggagcucuucgacggcuacgacagcacagcccccaggcuggggcgcuacuguggcucagggccuccugaggagguguacucggcgggagauucuguccuggugaaguuccacucggaugacaccaucaccaaaaaagguuuccaccugcgauacaccagcaccaaguuccaggacacacuccacagcaggaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6261 - RNA, 1467 nt, Artificial Sequence
  mRNA product Design5 comprising derived and/or modified sequence from Homo sapiens__NP_001191.1__HsBMP2 (wt)
gggagagucccgcagucggcguccagcggcucugcuuguucgugugugugucguugcaggccuuauucaagcuuaccaugguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcaggugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6262 - RNA, 1503 nt, Artificial Sequence
  mRNA product Design5 comprising derived and/or modified sequence from Homo sapiens__NP_001193.2__HsBMP4 (wt)
gggagagucccgcagucggcguccagcggcucugcuuguucgugugugugucguugcaggccuuauucaagcuuaccaugauuccugguaaccgaaugcugauggucguuuuauuaugccaaguccugcuaggaggcgcgagccaugcuaguuugauaccugagacggggaagaaaaaagucgccgagauucagggccacgcgggaggacgccgcucagggcagagccaugagcuccugcgggacuucgaggcgacacuucugcagauguuugggcugcgccgccgcccgcagccuagcaagagugccgucauuccggacuacaugcgggaucuuuaccggcuucagucuggggaggaggaggaagagcagauccacagcacuggucuugaguauccugagcgcccggccagccgggccaacaccgugaggagcuuccaccacgaagaacaucuggagaacaucccagggaccagugaaaacucugcuuuucguuuccucuuuaaccucagcagcaucccugagaacgaggugaucuccucugcagagcuucggcucuuccgggagcagguggaccagggcccugauugggaaaggggcuuccaccguauaaacauuuaugagguuaugaagcccccagcagaaguggugccugggcaccucaucacacgacuacuggacacgagacugguccaccacaaugugacacggugggaaacuuuugaugugagcccugcgguccuucgcuggacccgggagaagcagccaaacuaugggcuagccauugaggugacucaccuccaucagacucggacccaccagggccagcaugucaggauuagccgaucguuaccucaagggagugggaauugggcccagcuccggccccuccuggucaccuuuggccaugauggccggggccaugccuugacccgacgccggagggccaagcguagcccuaagcaucacucacagcgggccaggaagaagaauaagaacugccggcgccacucgcucuauguggacuucagcgaugugggcuggaaugacuggauuguggccccaccaggcuaccaggccuucuacugccauggggacugccccuuuccacuggcugaccaccucaacucaaccaaccaugccauugugcagacccuggucaauucugucaauuccaguauccccaaagccuguugugugcccacugaacugagugccaucuccaugcuguaccuggaugaguaugauaaggugguacugaaaaauuaucaggagaugguaguagagggaugugggugccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6263 - RNA, 1818 nt, Artificial Sequence
  mRNA product Design5 comprising derived and/or modified sequence from Homo sapiens__NP_001709.1__HsBMP6 (wt)
gggagagucccgcagucggcguccagcggcucugcuuguucgugugugugucguugcaggccuuauucaagcuuaccaugccggggcuggggcggagggcgcaguggcugugcugguggugggggcugcugugcagcugcugcgggcccccgccgcugcggccgcccuugcccgcugccgcggccgccgccgccggggggcagcugcugggggacggcgggagccccggccgcacggagcagccgccgccgucgccgcaguccuccucgggcuuccuguaccggcggcucaagacgcaggagaagcgggagaugcagaaggagaucuugucggugcuggggcucccgcaccggccccggccccugcacggccuccaacagccgcagcccccggcgcuccggcagcaggaggagcagcagcagcagcagcagcugccucgcggagagcccccucccgggcgacugaaguccgcgccccucuucaugcuggaucuguacaacgcccuguccgccgacaacgacgaggacggggcgucggagggggagaggcagcaguccuggccccacgaagcagccagcucgucccagcgucggcagccgcccccgggcgccgcgcacccgcucaaccgcaagagccuucuggcccccggaucuggcagcggcggcgcguccccacugaccagcgcgcaggacagcgccuuccucaacgacgcggacauggucaugagcuuugugaaccugguggaguacgacaaggaguucuccccucgucagcgacaccacaaagaguucaaguucaacuuaucccagauuccugagggugagguggugacggcugcagaauuccgcaucuacaaggacuguguuauggggaguuuuaaaaaccaaacuuuucuuaucagcauuuaucaagucuuacaggagcaucagcacagagacucugaccuguuuuuguuggacacccguguaguaugggccucagaagaaggcuggcuggaauuugacaucacggccacuagcaaucuguggguugugacuccacagcauaacauggggcuucagcugagcguggugacaagggauggaguccacguccacccccgagccgcaggccuggugggcagagacggcccuuacgacaagcagcccuucaugguggcuuucuucaaagugagugaggugcacgugcgcaccaccaggucagccuccagccggcgccgacaacagagucguaaucgcucuacccagucccaggacguggcgcgggucuccagugcuucagauuacaacagcagugaauugaaaacagccugcaggaagcaugagcuguaugugaguuuccaagaccugggauggcaggacuggaucauugcacccaagggcuaugcugccaauuacugugauggagaaugcuccuucccacucaacgcacacaugaaugcaaccaaccacgcgauugugcagaccuugguucaccuuaugaaccccgaguauguccccaaaccgugcugugcgccaacuaagcuaaaugccaucucgguucuuuacuuugaugacaacuccaaugucauucugaaaaaauacaggaauaugguuguaagagcuuguggaugccacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6264 - RNA, 1572 nt, Artificial Sequence
  mRNA product Design5 comprising derived and/or modified sequence from Homo sapiens__NP_001710.1__HsBMP7 (wt)
gggagagucccgcagucggcguccagcggcucugcuuguucgugugugugucguugcaggccuuauucaagcuuaccaugcacgugcgcucacugcgagcugcggcgccgcacagcuucguggcgcucugggcaccccuguuccugcugcgcuccgcccuggccgacuucagccuggacaacgaggugcacucgagcuucauccaccggcgccuccgcagccaggagcggcgggagaugcagcgcgagauccucuccauuuugggcuugccccaccgcccgcgcccgcaccuccagggcaagcacaacucggcacccauguucaugcuggaccuguacaacgccauggcgguggaggagggcggcgggcccggcggccagggcuucuccuaccccuacaaggccgucuucaguacccagggccccccucuggccagccugcaagauagccauuuccucaccgacgccgacauggucaugagcuucgucaaccucguggaacaugacaaggaauucuuccacccacgcuaccaccaucgagaguuccgguuugaucuuuccaagaucccagaaggggaagcugucacggcagccgaauuccggaucuacaaggacuacauccgggaacgcuucgacaaugagacguuccggaucagcguuuaucaggugcuccaggagcacuugggcagggaaucggaucucuuccugcucgacagccguacccucugggccucggaggagggcuggcugguguuugacaucacagccaccagcaaccacuggguggucaauccgcggcacaaccugggccugcagcucucgguggagacgcuggaugggcagagcaucaaccccaaguuggcgggccugauugggcggcacgggccccagaacaagcagcccuucaugguggcuuucuucaaggccacggagguccacuuccgcagcauccgguccacggggagcaaacagcgcagccagaaccgcuccaagacgcccaagaaccaggaagcccugcggauggccaacguggcagagaacagcagcagcgaccagaggcaggccuguaagaagcacgagcuguaugucagcuuccgagaccugggcuggcaggacuggaucaucgcgccugaaggcuacgccgccuacuacugugagggggagugugccuucccucugaacuccuacaugaacgccaccaaccacgccaucgugcagacgcugguccacuucaucaacccggaaacggugcccaagcccugcugugcgcccacgcagcucaaugccaucuccguccucuacuucgaugacagcuccaacgucauccugaagaaauacagaaacauggugguccgggccuguggcugccacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6265 - RNA, 576 nt, Artificial Sequence
  mRNA product Design5 comprising derived and/or modified sequence from Homo sapiens__NP_006264.2__HsCCL7 (wt)
gggagagucccgcagucggcguccagcggcucugcuuguucgugugugugucguugcaggccuuauucaagcuuaccaugaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcuuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6266 - RNA, 3900 nt, Artificial Sequence
  mRNA product Design5 comprising derived and/or modified sequence from Homo sapiens__NP_001954.2__HsEGF (wt)
gggagagucccgcagucggcguccagcggcucugcuuguucgugugugugucguugcaggccuuauucaagcuuaccaugcugcucacucuuaucauucuguugccaguaguuucaaaauuuaguuuuguuagucucucagcaccgcagcacuggagcuguccugaagguacucucgcaggaaaugggaauucuacuuguguggguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccugagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcagguggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcgaagcuuucauaugcccuccuaugggacacagacccuugaagggggugucgagaagccccauucucuccuaucagcuaacccauuauggcaacaaagggcccuggacccaccacaccaaauggagcugacucagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6267 - RNA, 786 nt, Artificial Sequence
  mRNA product Design5 comprising derived and/or modified sequence from Homo sapiens__NP_001423.1__HsEREG (wt)
gggagagucccgcagucggcguccagcggcucugcuuguucgugugugugucguugcaggccuuauucaagcuuaccaugaccgcggggaggaggauggagaugcucugugccggcagggucccugcgcugcugcucugccuggguuuccaucuucuacaggcaguccucaguacaacugugauuccaucauguaucccaggagaguccagugauaacugcacagcuuuaguucagacagaagacaauccacguguggcucaagugucaauaacaaaguguagcucugacaugaauggcuauuguuugcauggacagugcaucuaucugguggacaugagucaaaacuacugcaggugugaaguggguuauacugguguccgaugugaacacuucuuuuuaaccguccaccaaccuuuaagcaaagaauauguggcuuugaccgugauucuuauuauuuuguuucuuaucacagucgucgguuccacauauuauuucugcagaugguacagaaaucgaaaaaguaaagaaccaaagaaggaauaugagagaguuaccucaggggauccagaguugccgcaagucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6268 - RNA, 744 nt, Artificial Sequence
  mRNA product Design5 comprising derived and/or modified sequence from Homo sapiens__NP_000791.1__HsFGF1 (wt)
gggagagucccgcagucggcguccagcggcucugcuuguucgugugugugucguugcaggccuuauucaagcuuaccauggcugaaggggaaaucaccaccuucacagcccugaccgagaaguuuaaucugccuccagggaauuacaagaagcccaaacuccucuacuguagcaacgggggccacuuccugaggauccuuccggauggcacaguggaugggacaagggacaggagcgaccagcacauucagcugcagcucagugcggaaagcgugggggagguguauauaaagaguaccgagacuggccaguacuuggccauggacaccgacgggcuuuuauacggcucacagacaccaaaugaggaauguuuguuccuggaaaggcuggaggagaaccauuacaacaccuauauauccaagaagcaugcagagaagaauugguuuguuggccucaagaagaaugggagcugcaaacgcgguccucggacucacuauggccagaaagcaaucuuguuucucccccugccagucucuucugauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6269 - RNA, 1143 nt, Artificial Sequence
  mRNA product Design5 comprising derived and/or modified sequence from Homo sapiens__NP_001997.5__HsFGF2 (wt)
gggagagucccgcagucggcguccagcggcucugcuuguucgugugugugucguugcaggccuuauucaagcuuaccauggugggugugggggguggagauguagaagaugugacgccgcggcccggcgggugccagauuagcggacgcggugcccgcgguugcaacgggaucccgggcgcugcagcuugggaggcggcucuccccaggcggcguccgcggagacacccauccgugaaccccaggucccgggccgccggcucgccgcgcaccaggggccggcggacagaagagcggccgagcggcucgaggcugggggaccgcgggcgcggccgcgcgcugccgggcgggaggcuggggggccggggccggggccgugccccggagcgggucggaggccggggccggggccgggggacggcggcuccccgcgcggcuccagcggcucggggaucccggccgggccccgcagggaccauggcagccgggagcaucaccacgcugcccgccuugcccgaggauggcggcagcggcgccuucccgcccggccacuucaaggaccccaagcggcuguacugcaaaaacgggggcuucuuccugcgcauccaccccgacggccgaguugacgggguccgggagaagagcgacccucacaucaagcuacaacuucaagcagaagagagaggaguugugucuaucaaaggagugugugcuaaccguuaccuggcuaugaaggaagauggaagauuacuggcuucuaaauguguuacggaugaguguuucuuuuuugaacgauuggaaucuaauaacuacaauacuuaccggucaaggaaauacaccaguugguauguggcacugaaacgaacugggcaguauaaacuuggauccaaaacaggaccugggcagaaagcuauacuuuuucuuccaaugucugcuaagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6270 - RNA, 861 nt, Artificial Sequence
  mRNA product Design5 comprising derived and/or modified sequence from Homo sapiens__NP_002000.1__HsFGF7 (wt)
gggagagucccgcagucggcguccagcggcucugcuuguucgugugugugucguugcaggccuuauucaagcuuaccaugcacaaauggauacugacauggauccugccaacuuugcucuacagaucaugcuuucacauuaucugucuaguggguacuauaucuuuagcuugcaaugacaugacuccagagcaaauggcuacaaaugugaacuguuccagcccugagcgacacacaagaaguuaugauuacauggaaggaggggauauaagagugagaagacucuucugucgaacacagugguaccugaggaucgauaaaagaggcaaaguaaaagggacccaagagaugaagaauaauuacaauaucauggaaaucaggacaguggcaguuggaauuguggcaaucaaagggguggaaagugaauucuaucuugcaaugaacaaggaaggaaaacucuaugcaaagaaagaaugcaaugaagauuguaacuucaaagaacuaauucuggaaaaccauuacaacacauaugcaucagcuaaauggacacacaacggaggggaaauguuuguugccuuaaaucaaaaggggauuccuguaagaggaaaaaaaacgaagaaagaacaaaaaacagcccacuuucuuccuauggcaauaacuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6271 - RNA, 903 nt, Artificial Sequence
  mRNA product Design5 comprising derived and/or modified sequence from Homo sapiens__NP_001936.1__HsHBEGF (wt)
gggagagucccgcagucggcguccagcggcucugcuuguucgugugugugucguugcaggccuuauucaagcuuaccaugaagcugcugccgucgguggugcugaagcucuuucuggcugcaguucucucggcacuggugacuggcgagagccuggagcggcuucggagagggcuagcugcuggaaccagcaacccggacccucccacuguauccacggaccagcugcuaccccuaggaggcggccgggaccggaaaguccgugacuugcaagaggcagaucuggaccuuuugagagucacuuuauccuccaagccacaagcacuggccacaccaaacaaggaggagcacgggaaaagaaagaagaaaggcaaggggcuagggaagaagagggacccaugucuucggaaauacaaggacuucugcauccauggagaaugcaaauaugugaaggagcuccgggcucccuccugcaucugccacccggguuaccauggagagaggugucaugggcugagccucccaguggaaaaucgcuuauauaccuaugaccacacaaccauccuggccgugguggcuguggugcugucaucugucugucugcuggucaucguggggcuucucauguuuagguaccauaggagaggagguuaugauguggaaaaugaagagaaagugaaguugggcaugacuaauucccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6272 - RNA, 2463 nt, Artificial Sequence
  mRNA product Design5 comprising derived and/or modified sequence from Homo sapiens__NP_000592.3__HsHGF (wt)
gggagagucccgcagucggcguccagcggcucugcuuguucgugugugugucguugcaggccuuauucaagcuuaccaugugggugaccaaacuccugccagcccugcugcugcagcauguccuccugcaucuccuccugcuccccaucgccauccccuaugcagagggacaaaggaaaagaagaaauacaauucaugaauucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaauuccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcuuggcuuggaauucaugauguccacggaagaggagaugagaaaugcaaacagguucucaauguuucccagcugguauauggcccugaaggaucagaucugguuuuaaugaagcuugccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6273 - RNA, 2202 nt, Artificial Sequence
  mRNA product Design5 comprising derived and/or modified sequence from Homo sapiens__NP_005336.3 __HsHSPA1A (wt)
gggagagucccgcagucggcguccagcggcucugcuuguucgugugugugucguugcaggccuuauucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggcggacaagaagaaggugcuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccugggggcuucggggcucagggucccaagggagggucugggucaggccccaccauugaggagguagauuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6274 - RNA, 2202 nt, Artificial Sequence
  mRNA product Design5 comprising derived and/or modified sequence from Homo sapiens__NP_005337.2 __HsHSPA1B (wt)
gggagagucccgcagucggcguccagcggcucugcuuguucgugugugugucguugcaggccuuauucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggcggacaagaagaagguucuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccuggcggcuucggggcucagggucccaagggagggucugggucaggcccuaccauugaggagguggauuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6275 - RNA, 2202 nt, Artificial Sequence
  mRNA product Design5 comprising derived and/or modified sequence from Homo sapiens__NP_005518.3 __HsHSPA1L (wt)
gggagagucccgcagucggcguccagcggcucugcuuguucgugugugugucguugcaggccuuauucaagcuuaccauggcuacugccaagggaaucgccauaggcaucgaccugggcaccaccuacuccuguguggggguguuccagcacggcaagguggagaucaucgccaacgaccagggcaaccgcaccacccccagcuacguggccuucacagacaccgagcggcucauuggggaugcggccaagaaccagguagcaaugaauccccagaacacuguuuuugaugcuaaacgucugaucggcaggaaauuuaaugauccuguuguacaagcagauaugaaacuuuggccuuuucaagugauuaaugaaggaggcaagcccaaaguccuuguguccuacaaaggggagaauaaagcuuucuacccugaggaaaucucuucgaugguauugacuaaguugaaggagacugcugaggccuuuuugggccacccugucaccaaugcagugauuaccgugccagccuauuucaaugacucucaacgucaggcuacuaaggaugcaggugugauugcuggacuuaaugugcuaagaaucaucaaugagcccacggcugcugccauugccuaugguuuagauaaaggaggucaaggagaacgacauguccugauuuuugaucuggguggaggcacauuugaugugucaauucugaccauagaugaugggauuuuugagguaaaggccacugcuggggacacucaccuggguggggaggacuuugacaacaggcuugugagccacuucguggaggaguucaagaggaaacacaaaaaggacaucagccagaacaagcgagccgugaggcggcugcgcaccgccugcgagagggccaagaggacccugucguccagcacccaggccaaccuagaaauugauucacuuuaugaaggcauugacuucuauacauccaucaccagagcucgauuugaagaguugugugcagaccuguuuagggguacccuggagccuguagaaaaagcgcuucgggaugccaagauggauaaggcuaaaauccaugacauuguuuuaguagggggcuccacccgcauccccaaggugcagcggcugcuucaggacuacuucaauggacgugaucucaacaagagcaucaacccugaugaggccguagcauauggggcugcgguacaagcagccauccugaugggggacaagucugagaagguacaggaccugcugcugcuggacguggcuccccugucccuggggcuggagacggcugggggcgugaugacugcccugauaaagcgcaacuccaccauccccaccaagcagacacagauuuucaccaccuacucugacaaccaacccggggugcugauccagguguaugagggcgagagggccaugacaaaggacaacaaccugcuggggcgguuugaccugacuggaaucccuccagcacccaggggaguuccucagaucgaggugacguuugacauugaugccaaugguauucucaaugucacagccacggacaagagcaccggcaaggugaacaagaucaccaucaccaaugacaagggccgccugagcaaggaggagauugagcgcaugguucuggaugcugagaaauauaaagcugaagaugagguccagagggagaaaauugcugcaaagaaugccuuagaauccuaugcuuuuaacaugaagaguguugugagugaugaagguuugaagggcaagauuagugagucugauaaaaauaaaauauuggauaaaugcaacgagcuccuuucguggcuggaggucaaucaacuggcagagaaagaugaguuugaucauaagagaaaggaauuggagcagauguguaacccuaucaucacaaaacucuaccaaggaggaugcacugggccugccugcggaacaggguaugugccuggaaggccugccacaggccccacaauugaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6276 - RNA, 2196 nt, Artificial Sequence
  mRNA product Design5 comprising derived and/or modified sequence from Homo sapiens__NP_068814.2 __HsHSPA2 (wt)
gggagagucccgcagucggcguccagcggcucugcuuguucgugugugugucguugcaggccuuauucaagcuuaccaugucugcccguggcccggcuaucggcaucgaccugggcaccaccuauucgugcgucggggucuuccaacauggcaagguggagaucaucgccaacgaccagggcaaucgcaccacccccagcuacguggccuucacggacaccgagcgccucaucggcgacgccgccaagaaccagguggccaugaaccccaccaacaccaucuucgacgccaagaggcugauuggacggaaauucgaggaugccacagugcagucggauaugaaacacuggccguuccggguggugagcgagggaggcaagcccaaagugcaaguagaguacaagggggagaccaagaccuucuucccagaggagauauccuccaugguccucacgaagaugaaggagaucgcggaagccuaccuggggggcaaggugcacagcgcggucauaacggucccggccuauuucaacgacucgcagcgccaggccaccaaggacgcaggcaccaucacggggcucaaugugcugcgcaucaucaacgagcccacggcggcggccaucgccuacggccuggacaagaagggcugcgcgggcggcgagaagaacgugcucaucuuugaccugggcgguggcacuuucgacguguccauccugaccaucgaggauggcaucuucgaggugaaguccacggccggcgacacccaccugggcggugaggacuucgacaaccgcauggugagccaccuggcggaggaguucaagcgcaagcacaagaaggacauugggcccaacaagcgcgccgugaggcggcugcgcaccgcuugcgagcgcgccaagcgcacccugagcucguccacgcaggcgagcaucgagaucgacucgcucuacgagggcguggacuucuauacguccaucacgcgcgcccgcuucgaggagcucaaugccgaccucuuucgcgggacccuggagccgguggagaaggcgcugcgcgacgccaagcuggacaagggccagauccaggagaucgugcuggugggcggcuccacucguauccccaagauccagaagcugcugcaggauuucuucaacggcaaggagcugaacaagagcaucaaccccgacgaggcgguggccuauggcgccgcggugcaggcggccauccucaucggcgacaaaucagagaaugugcaggaccugcugcuacucgacgugaccccguugucgcugggcaucgagacagcuggcggugucaugaccccacucaucaagaggaacaccacgauccccaccaagcagacgcagaccuucaccaccuacucggacaaccagagcagcguacuggugcagguauacgagggcgaacgggccaugaccaaggacaauaaccugcugggcaaguucgaccugaccgggauucccccugcgccucgcggggucccccaaaucgagguuaccuucgacauugacgccaauggcauccuuaacguuaccgccgccgacaagagcaccgguaaggaaaacaaaaucaccaucaccaaugacaaaggucgucugagcaaggacgacauugaccggauggugcaggaggcggagcgguacaaaucggaagaugaggcgaaucgcgaccgagucgcggccaaaaacgcccuggaguccuauaccuacaacaucaagcagacgguggaagacgagaaacugaggggcaagauuagcgagcaggacaaaaacaagauccucgacaagugucaggaggugaucaacuggcucgaccgaaaccagauggcagagaaagaugaguaugaacacaagcagaaagagcucgaaagaguuugcaaccccaucaucagcaaacuuuaccaaggugguccuggcggcggcagcggcggcggcgguucaggagccuccgggggacccaccaucgaagaaguggacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6277 - RNA, 2799 nt, Artificial Sequence
  mRNA product Design5 comprising derived and/or modified sequence from Homo sapiens__NP_002145.3 __HsHSPA4 (wt)
gggagagucccgcagucggcguccagcggcucugcuuguucgugugugugucguugcaggccuuauucaagcuuaccaugucgguggugggcauagaccugggcuuccagagcugcuacgucgcuguggcccgcgccggcggcaucgagacuaucgcuaaugaguauagcgaccgcugcacgccggcuugcauuucuuuugguccuaagaaucguucaauuggagcagcagcuaaaagccagguaauuucuaaugcaaagaacacaguccaaggauuuaaaagauuccauggccgagcauucucugauccauuuguggaggcagaaaaaucuaaccuugcauaugauauugugcaguugccuacaggauuaacagguauaaaggugacauauauggaggaagagcgaaauuuuaccacugagcaagugacugccaugcuuuuguccaaacugaaggagacagccgaaaguguucuuaagaagccuguaguugacuguguuguuucgguuccuuguuucuauacugaugcagaaagacgaucagugauggaugcaacacagauugcuggucuuaauugcuugcgauuaaugaaugaaaccacugcaguugcucuugcauauggaaucuauaagcaggaucuuccugccuuagaagagaaaccaagaaauguaguuuuuguagacaugggccacucugcuuaucaaguuucuguaugugcauuuaauagaggaaaacugaaaguucuggccacugcauuugacacgacauugggagguagaaaauuugaugaaguguuaguaaaucacuucugugaagaauuugggaagaaauacaagcuagacauuaaguccaaaauccgugcauuauuacgacucucucaggagugugagaaacucaagaaauugaugagugcaaaugcuucagaucucccuuugagcauugaauguuuuaugaaugauguugauguaucuggaacuaugaauagaggcaaauuucuggagaugugcaaugaucucuuagcuagaguggagccaccacuucguaguguuuuggaacaaaccaaguuaaagaaagaagauauuuaugcaguggagauaguugguggugcuacacgaaucccugcgguaaaagagaagaucagcaaauuuuucgguaaagaacuuaguacaacauuaaaugcugaugaagcugucacucgaggcugugcauugcagugugccaucuuaucgccugcuuucaaagucagagaauuuucuaucacugauguaguaccauauccaauaucucugagauggaauucuccagcugaagaagggucaagugacugugaagucuuuuccaaaaaucaugcugcuccuuucucuaaaguucuuacauuuuauagaaaggaaccuuucacucuugaggccuacuacagcucuccucaggauuugcccuauccagauccugcuauagcucaguuuucaguucagaaagucacuccucagucugauggcuccaguucaaaagugaaagucaaaguucgaguaaauguccauggcauuuucaguguguccagugcaucuuuaguggagguucacaagucugaggaaaaugaggagccaauggaaacagaucagaaugcaaaggaggaagagaagaugcaaguggaccaggaggaaccacauguugaagagcaacagcagcagacaccagcagaaaauaaggcagagucugaagaaauggagaccucucaagcuggauccaaggauaaaaagauggaccaaccaccccaagccaagaaggcaaaagugaagaccaguacuguggaccugccaaucgagaaucagcuauuauggcagauagacagagagaugcucaacuuguacauugaaaaugaggguaagaugaucaugcaggauaaacuggagaaggagcggaaugaugcuaagaacgcaguggaggaauauguguaugaaaugagagacaagcuuaguggugaauaugagaaguuugugagugaagaugaucguaacaguuuuacuuugaaacuggaagauacugaaaauugguuguaugaggauggagaagaccagccaaagcaaguuuauguugauaaguuggcugaauuaaaaaaucuaggucaaccuauuaagauacguuuccaggaaucugaagaacgaccaaaauuauuugaagaacuagggaaacagauccaacaguauaugaaaauaaucagcucuuucaaaaacaaggaggaccaguaugaucauuuggaugcugcugacaugacaaagguagaaaaaagcacaaaugaagcaauggaguggaugaauaacaagcuaaaucugcagaacaagcagaguuugaccauggauccaguugucaagucaaaagagauugaagcuaaaauuaaggagcugacaaguacuuguagcccuauaauuucaaagcccaaacccaaaguggaaccuccaaaagaggaacaaaaaaaugcagagcagaauggaccaguggauggacaaggagacaacccaggcccccaggcugcugagcaggguacagacacagcugugccuucggauucagacaagaagcuuccugaaauggacauugauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6278 - RNA, 2796 nt, Artificial Sequence
  mRNA product Design5 comprising derived and/or modified sequence from Homo sapiens__NP_055093.2 __HsHSPA4L (wt)
gggagagucccgcagucggcguccagcggcucugcuuguucgugugugugucguugcaggccuuauucaagcuuaccaugucugugguuggcauugaccucggcuuucucaacugcuacauugcugucgcgagaaguggcggcaucgagaccaucgccaaugaguacagcgacagguguaccccggccuguauaucauugggaucaagaacucgagccauuggaaaugcagcaaagagccagauagucacgaacguaagaaauacaauucauggcuucaaaaagcuucaugggcgaucauuugaugaucccauugugcaaacugaaaggaucaggcuucccuaugaacugcagaaaaugccuaauggaagugcaggaguuaaggugcgguacuuagaggaagagagaccuuuugcaauugagcaaguuacuggaaugcuguuagccaagcuuaaagagacuucagaaaaugcuuugaagaaaccaguggcugacugugugauuucaauuccuagcuuuuuuacugaugccgagagaagaucugugauggcugcagcccagguugcaggcuuaaauuguuuaagguugaugaaugaaacuacugcaguugcacuggcguauggaauuuauaaacaggaucuucccccauuagaugagaaaccaagaaauguaguauuuauugauaugggacauucugccuaucaggucuugguuugugcuuuuaacaaaggaaaacuuaaagucuuggcuacuaccuuugauccauauuuggguggcaggaacuuugaugaggcuuuaguagacuacuucugugaugaguucaagaccaaauauaagauaaaugugaaagaaaacucucgggccuuguugcguuuauaucaggaaugugaaaaacuaaagaagcuaaugagugcaaaugcaucagaucuuccauugaacauugaguguuucaugaaugaccuugauguuucuaguaaaaugaacagggcucaauuugaacaacugugugcuucccuuuuggccaggguugaaccaccuuuaaaagcaguaauggaacaagcuaacuuacaacgugaagacauuaguaguauagaaauuguaggaggagcaacacgaauuccugcagugaaagaacaaaucacuaaauucuuucuuaaagacauaaguaccacauuaaaugcugaugaagcuguugcaagaggaugugcguuacagugugcgauucucucaccagcauuuaaagugcgugaauuuuccauaacagaccuuguucccuauucaaucacauuaagguggaagaccucuuuugaagauggaaguggggaaugugaaguuuucuguaagaaccauccugccccauucucaaaagucauuacuuuccacaagaaggaaccauuugaacuagaagcauuuuauacuaauuuacaugaagugccuuauccugaugcaagaauugggagcuucacuauucagaauguuuuuccacagucugauggugauaguuccaaagugaagguuaaaguucguguuaacauccauggaaucuucaguguggcuagcgcaucaguaauugagaagcaaaauuuggaaggcgaucacagugaugcuccaauggagacagaaacuucauuuaaaaaugaaaacaaagauaauauggauaaaaugcagguugaucaagaagaagggcaucaaaaaugucaugcugaacacacuccagaagaggaaauugaucauacaggagccaaaacaaagucagcugucucagacaaacaagaccgauuaaaucagacacuuaaaaaaggaaaagucaaaaguauugaucuaccgauccagaguagccuauguagacaacuaggccaagaucuucucaacagcuacauugaaaaugaggggaagaugaucaugcaagauaaguuagagaaagaaagaaaugaugcuaagaaugccguugaagaauauguauaugauuuuagagacaggcugggcacugucuaugaaaaauucaucacuccagaagacuugaguaaacugucugcaguauuggaagacacagaaaauuggcuuuaugaagacggagaggaccaaccuaaacaaguuuauguggauaagcuucaagaacuaaagaaauacggccagccuauucaaaugaaguacauggagcaugaagagagaccaaaagccuuaaaugacuugggaaaaaagauccaacuugucaugaaagugauagaagcuuauagaaacaaggaugaaagauaugaucaucuggauccuacugaaauggaaaagguugaaaaauguaucagugaugccaugaguuggcugaauaguaagaugaaugcacagaacaaacuaagucucacucaagauccugugguaaaaguuucagaaauaguagcaaagucaaaggaacuggauaauuucuguaaccccaucauuuacaagcccaaaccaaaagcagaaguuccugaagacaaaccaaaagcuaauagugaacacaauggcccaauggauggacagaguggaacugaaacuaaaucagauucaacaaaagacagcucacagcauacuaaauccucuggagagauggaaguggacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6279 - RNA, 2241 nt, Artificial Sequence
  mRNA product Design5 comprising derived and/or modified sequence from Homo sapiens__NP_005338.1__HsHSPA5 (wt)
gggagagucccgcagucggcguccagcggcucugcuuguucgugugugugucguugcaggccuuauucaagcuuaccaugaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagagcucaacauggaucuguuccggucuacuaugaagcccguccagaaaguguuggaagauucugauuugaagaagucugauauugaugaaauuguucuuguugguggcucgacucgaauuccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaauuccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6280 - RNA, 2208 nt, Artificial Sequence
  mRNA product Design5 comprising derived and/or modified sequence from Homo sapiens__NP_002146.2__HsHSPA6 (wt)
gggagagucccgcagucggcguccagcggcucugcuuguucgugugugugucguugcaggccuuauucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccggguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccgccuauuucaaugacucgcagcgccaggccaccaaggacgcgggggccaucgcggggcucaacguguugcggaucaucaaugagcccacggcagcugccaucgccuaugggcuggaccggcggggcgcgggagagcgcaacgugcucauuuuugaccugggugggggcaccuucgaugugucgguucucuccauugacgcuggugucuuugaggugaaagccacugcuggagauacccaccugggaggagaggacuucgacaaccggcucgugaaccacuucauggaagaauuccggcggaagcaugggaaggaccugagcgggaacaagcgugcccugcgcaggcugcgcacagccugugagcgcgccaagcgcacccuguccuccagcacccaggccacccuggagauagacucccuguucgagggcguggacuucuacacguccaucacucgugcccgcuuugaggaacugugcucagaccucuuccgcagcacccuggagccgguggagaaggcccugcgggaugccaagcuggacaaggcccagauucaugacgucguccugguggggggcuccacacgcauccccaaggugcagaaguugcugcaggacuucuucaacggcaaggagcugaacaagagcaucaacccugaugaggcuguggccuauggggcugcugugcaggcggccguguugaugggggacaaaugugagaaagugcaggaucuccugcugcuggauguggcuccccugucucuggggcuggagacagcagguggggugaugaccacgcugauccagaggaacgccacuauccccaccaagcagacccagacuuucaccaccuacucggacaaccagccuggggucuucauccagguguaugagggugagagggccaugaccaaggacaacaaccugcuggggcguuuugaacucaguggcaucccuccugccccacguggagucccccagauagaggugacuuuugacauugaugcuaauggcauccugagcgugacagccacugacaggagcacagguaaggcuaacaagaucaccaucaccaaugacaagggccggcugagcaaggaggagguggagaggaugguucaugaagccgagcaguacaaggcugaggaugaggcccagagggacagaguggcugccaaaaacucgcuggaggcccaugucuuccaugugaaagguucuuugcaagaggaaagccuuagggacaagauucccgaagaggacaggcgcaaaaugcaagacaagugucgggaaguccuugccuggcuggagcacaaccagcuggcagagaaggaggaguaugagcaucagaagagggagcuggagcaaaucugucgccccaucuucuccaggcucuauggggggccuggugucccugggggcagcaguuguggcacucaagcccgccagggggaccccagcaccggccccaucauugaggagguugauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6281 - RNA, 1380 nt, Artificial Sequence
  mRNA product Design5 comprising derived and/or modified sequence from Homo sapiens__P48741__HsHSPA7 (wt)
gggagagucccgcagucggcguccagcggcucugcuuguucgugugugugucguugcaggccuuauucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccagguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccaccuauuucaguaacucgcagcgccaggccaccaaggacgcgggggccaucgcggggcucaaggugcugccgaucaucaaugaggccacggcagcagccaucgccuaugggcuggaccggcggggcgcgggaaagcgcaacgugcucauuuuugaccugggugggggcaccuucgaugugucgguucucuccauugacgccggugucuuugaggugaaagccacugcuggagauacccaccugggaggagaggacuucgacaaccggcucgugaaccacuucauggaagaauuccggcggaagcaugggaaggaccugagcgggaacaagcgugcccugcgcaggcugcgcacagccugugagcgcgccaagcgcaccccguccuccagcacccaggccacccuggagauagacucccuguucgagggcguggacuucuacaaguccaucacucgugcccgcuuugaggaacugugcucagaccucuuccgcagcacccuggagccgguggagaaggcccugcgggaugccaagcuggacaaggcccagauucaugacuucguccuggggggagggcuccacucgcauccccaaggugcagaaguugcugcaggacuucuucaacggcaaggagcugaacaagagcaucaacccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6282 - RNA, 2217 nt, Artificial Sequence
  mRNA product Design5 comprising derived and/or modified sequence from Homo sapiens__NP_006588.1 __HsHSPA8 (wt)
gggagagucccgcagucggcguccagcggcucugcuuguucgugugugugucguugcaggccuuauucaagcuuaccauguccaagggaccugcaguugguauugaucuuggcaccaccuacucuuguguggguguuuuccagcacggaaaagucgagauaauugccaaugaucagggaaaccgaaccacuccaagcuaugucgccuuuacggacacugaacgguugaucggugaugccgcaaagaaucaaguugcaaugaaccccaccaacacaguuuuugaugccaaacgucugauuggacgcagauuugaugaugcuguuguccagucugauaugaaacauuggcccuuuaugguggugaaugaugcuggcaggcccaagguccaaguagaauacaagggagagaccaaaagcuucuauccagaggaggugucuucuaugguucugacaaagaugaaggaaauugcagaagccuaccuugggaagacuguuaccaaugcuguggucacagugccagcuuacuuuaaugacucucagcgucaggcuaccaaagaugcuggaacuauugcuggucucaauguacuuagaauuauuaaugagccaacugcugcugcuauugcuuacggcuuagacaaaaagguuggagcagaaagaaacgugcucaucuuugaccugggagguggcacuuuugaugugucaauccucacuauugaggauggaaucuuugaggucaagucuacagcuggagacacccacuuggguggagaagauuuugacaaccgaauggucaaccauuuuauugcugaguuuaagcgcaagcauaagaaggacaucagugagaacaagagagcuguaagacgccuccguacugcuugugaacgugcuaagcguacccucucuuccagcacccaggccaguauugagaucgauucucucuaugaaggaaucgacuucuauaccuccauuacccgugcccgauuugaagaacugaaugcugaccuguuccguggcacccuggacccaguagagaaagcccuucgagaugccaaacuagacaagucacagauucaugauauuguccugguuggugguucuacucguauccccaagauucagaagcuucuccaagacuucuucaauggaaaagaacugaauaagagcaucaacccugaugaagcuguugcuuauggugcagcuguccaggcagccaucuugucuggagacaagucugagaauguucaagauuugcugcucuuggaugucacuccucuuucccuugguauugaaacugcugguggagucaugacuguccucaucaagcguaauaccaccauuccuaccaagcagacacagaccuucacuaccuauucugacaaccagccuggugugcuuauucagguuuaugaaggcgagcgugccaugacaaaggauaacaaccugcuuggcaaguuugaacucacaggcauaccuccugcaccccgagguguuccucagauugaagucacuuuugacauugaugccaaugguauacucaaugucucugcuguggacaagaguacgggaaaagagaacaagauuacuaucacuaaugacaagggccguuugagcaaggaagacauugaacguaugguccaggaagcugagaaguacaaagcugaagaugagaagcagagggacaaggugucauccaagaauucacuugaguccuaugccuucaacaugaaagcaacuguugaagaugagaaacuucaaggcaagauuaacgaugaggacaaacagaagauucuggacaaguguaaugaaauuaucaacuggcuugauaagaaucagacugcugagaaggaagaauuugaacaucaacagaaagagcuggagaaaguuugcaaccccaucaucaccaagcuguaccagagugcaggaggcaugccaggaggaaugccugggggauuuccuggugguggagcuccucccucugguggugcuuccucagggcccaccauugaagagguugauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6283 - RNA, 2316 nt, Artificial Sequence
  mRNA product Design5 comprising derived and/or modified sequence from Homo sapiens__NP_004125.3 __HsHSPA9 (wt)
gggagagucccgcagucggcguccagcggcucugcuuguucgugugugugucguugcaggccuuauucaagcuuaccaugauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaagagccagguauucucuacugccgcugauggucaaacgcaaguggaaauuaaagugugucagggugaaagagagauggcuggagacaacaaacuccuuggacaguuuacuuugauuggaauuccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaauucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucacugaagcuguucgaaauggcauacaaaaagauggcaucugagcgagaaggcucuggaaguucuggcacuggggaacaaaaggaagaucaaaaggaggaaaaacaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6284 - RNA, 2304 nt, Artificial Sequence
  mRNA product Design5 comprising derived and/or modified sequence from Homo sapiens__NP_079291.2__HsHSPA12A (wt)
gggagagucccgcagucggcguccagcggcucugcuuguucgugugugugucguugcaggccuuauucaagcuuaccauggcggacaaggaggccggcggcagcgacgggccccgagaaacggcucccacaucugcauauucaucuccagcccggagucuuggggacacaggaauaacgccucugucccccucccauauugugaacgacacugacuccaacgucucagaacagcagucauuucucguggugguggccgucgacuuugggaccacauccaguggcuaugccuacagcuucaccaaggagccggaaugcauccaugugaugaggcgaugggagggaggugacccugguguguccaaucagaagacuccaaccaccaucuugcugacucccgagaggaaguuccacagcuucggguaugccgccagggacuuuuaccaugaccuggaucccaaugaggccaagcaguggcuguaccuggagaaguucaagaugaagcugcacaccacuggggaccucaccauggauacagaccugacggcagcaaauggcaagaaagucaaagcccuugaaaucuuugcuuaugcccugcaguacuuuaaggagcaggcgcugaaggagcugagugaccaggcggguucggaguucgagaacucugaugucagaugggucaucacggugccugccaucuggaagcagccggccaagcaguucaugagacaagcugccuaccaggcaggccuggccucccccgagaacucggagcagcucaucauugccuuggagccugaggcagccucuaucuacugccgaaagcugcggcuacaccagaugauugagcugagcagcaaggcagccgucaauggguacagcggcagugacacaguaggagcuggguuuacacaggcuaaggaacacauacggcguaaucggcagagucggaccuuuuugguggagaaugucauaggagaaaucugguccgagcuggaggaaggugauaaguaugugguuguggacaguggcgguggcaccguagaccugacaguccaucagauccgguuaccggagggacaccuuaaggaacuguauaaagcaacaggcggacccuauggaucuuuaggaguagauuaugaguucgaaaaacuucuguauaaaauauuuggagaggauuuuauugaacaauucaaaaucaaacgcccugcagccuggguugacuuaaugauugcguuugagucucgcaaaagggcggcugccccagacagaacuaacccgcugaacaucacccugcccuucuccuucauugacuacuacaagaaguuccgcgggcacaguguggagcacgccuugcggaaaagcaauguggauuuugugaagugguccucgcaggggaugcugcggaugaguccagaugccaugaacgcccuuuuuaagccgaccaucgauagcaucauugagcaucuccgggaccuguuucagaagcccgagguguccaccgucaaguuccucuuucuggugggcggcuuugccgaggcgccccugcugcagcaggcggugcaggcugcuuuuggggaccagugccggaucaucaucccccaggacgugggccucaccauccucaagggugccguccucuuuggccuggaccccgcggucaucaaggugcgccggucgccgcucaccuacgggguaggcgugcugaaccgcuacguggagggcaagcacccgccugagaagcugcuggugaaggauggcacucgguggugcaccgacgucuuugacaaguucaucucugccgaccagucuguggcucugggugagcuggucaagcguagcuacaccccggccaagcccucccagcuggucauugucaucaacaucuacagcucugagcacgacaacgucagcuucaucacugaucccggggugaagaaguguggcacgcuccgccuggaucucacagggaccaguggcacugcggugcccgcccggagggagauccagacccuuaugcaguucggggacaccgagaucaaagccacagccauugauauagccacuucgaagagugucaaaguugggaucgacuucuuaaauuacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6285 - RNA, 2337 nt, Artificial Sequence
  mRNA product Design5 comprising derived and/or modified sequence from Homo sapiens__NP_443202.3 __HsHSPA12B (wt)
gggagagucccgcagucggcguccagcggcucugcuuguucgugugugugucguugcaggccuuauucaagcuuaccauguuggcugucccggagaugggccugcaggggcuguacaucggcuccagcccggagcgguccccagugccuagcccacccggcuccccgaggacccaggaaagcugcggcauugccccccucacacccucgcagucuccaaaacccgagguccgagccccccagcaggccuccuucucuguggugguggccauugacuucggcaccacgucuaguggcuaugcuuucagcuuugccagugacccugaggccauccacaugaugaggaaaugggagggcggagacccgggcguggcccaccagaagaccccgaccugccugcugcugacuccggagggcgccuuccacagcuuuggcuacaccgcccgcgauuacuaccaugaccuggaccccgaagaggcgcgggacuggcucuacuucgagaaguucaagaugaagauccacagcgccacggaucucaccuugaagacccagcuagaggcaguaaauggaaagacgaugcccgcccuggagguguucgcccaugcccugcgcuucuucagggagcacgcccuucaggagcugagggagcagagcccaucgcugccagagaaggacacugugcgcuggguguugacggugccugccaucuggaaacagccagccaagcaguucaugcgggaggcugccuaccuggcuggacuagugucccgagagaaugcagagcagcuacucaucgcccuggagcccgaggccgccucgguauacugccgcaagcugcgccugcaccagcuccuggaccugaguggccgggccccagguggugggcgccugggugagcgccgcuccaucgacuccagcuuccgucaggcucgggagcagcugcgaaggucccgccacagccgcacguuccugguggagucaggcguaggagagcugugggcagagaugcaagcaggagaccgcuacgugguggccgacugcggcggaggcaccguggaccugacggugcaccagcuggagcagccccauggcacccucaaggagcucuacaaggcaucugggggcccuuauggcgcggugggcguggaccuggccuucgagcagcugcugugccgcaucuucggcgaggacuucaucgccaccuucaaaaggcaacggccggcagccuggguagaucugaccaucgccuucgaggcucgcaagcgcacugcuggcccacaccgugcaggggcgcucaacaucucgcugcccuucuccuucauugacuucuaccgcaagcagcggggccacaacguggagaccgcucugcgcaggagcagcgugaacuucgugaagugguccucacaggggaugcuccgaaugucuugugaagccaugaacgagcucuuucagcccaccgucagcgggaucauccagcacauagaggcccugcuggcacggccggaggugcagggugugaagcugcuguuccuagugggcggcuucgccgagucagcggugcugcagcacgcggugcaggcggcgcugggcgcccgcggucugcgugucguggucccgcacgacgugggccucaccauccucaaaggcgcggugcuguucggccaggcgccgggcguggugcggguccgccgcucgccgcucaccuauggcgugggcgugcucaaccgcuuugugccugggcgccacccgcccgaaaagcugcugguucgcgacggccgccgcuggugcaccgacgucuucgagcgcuucguggccgccgagcagucgguggcccugggcgaggaggugcggcgcagcuacugcccggcgcgucccggccagcggcgcguacucaucaaccuguacugcugcgcggcagaggaugcgcgcuucaucaccgaccccggcgugcgcaaaugcggcgcgcucagccucgagcuugagcccgccgacugcggccaggacaccgccggcgcgccucccggccgccgcgagauccgcgccgccaugcaguuuggcgacaccgaaauuaaggucaccgccgucgacgucagcaccaaucgcuccgugcgcgcguccaucgacuuucuuuccaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6286 - RNA, 1692 nt, Artificial Sequence
  mRNA product Design5 comprising derived and/or modified sequence from Homo sapiens__NP_008879.3__HsHSPA13 (wt)
gggagagucccgcagucggcguccagcggcucugcuuguucgugugugugucguugcaggccuuauucaagcuuaccauggccagagagaugacgaucuuaggaucggcuguuuugacucuccuguuggccggcuauuuggcacaacaguauuuaccauugccuacuccuaaagugauugguauugaucuuggcaccaccuauuguucuguugggguguuuuuuccuggcacaggaaaaguaaaggugauuccagaugaaaaugggcauaucagcauacccagcauggugucuuuuacugacaaugauguauaugugggauaugaaagcguagagcuggcagauucaaauccucaaaacacaauauaugaugccaaaagauucauaggcaagauuuuuaccgcagaagaguuggaggcugaaauuggcagauacccauuuaagguuuuaaacaaaaauggaaugguugaguuuucugugacaaguaaugagaccaucacaguguccccagaauauguuggcucucgacuauuguugaaguuaaaggaaauggcagaggcauaucuuggaaugccaguugccaaugcugucauuucuguaccagcagaauuugaucuaaaacagagaaauucaacaauugaagcugcuaaccuugcaggacugaagauuuugaggguaauaaaugaacccacagcagcagcuauggccuauggucuccacaaggcugacgucuuccacgucuuggugauagacuugggcggaggaacucuagaugugucuuuacugaauaaacaaggagggauguuucuaacccgagcaaugucuggaaacaauaaacuuggaggacaggacuucaaucagagauugcuucaguacuuauauaaacagaucuaucaaacauauggcuucgugcccucuaggaaagaggaaauccacagauugagacaagcuguggaaauggucaaauuaaaucugacucuucaucaaucugcucaguugucaguauuacuaacgguggaggagcaggacaggaaggaaccucacaguagugacacugaacugccaaaagacaaacuuuccucagcagaugaccaucgcgugaacaguggguuuggacguggccuuucugauaagaaaaguggagaaagucagguuuuauuugaaacagaaauaucacggaaacucuuugauacccuuaaugaagaccucuuucagaaaauacugguacccauucagcaaguauugaaagaaggccaccuggaaaagacugagauugaugaggugguuuuaguugggggcuccacucguauuccucggauccgucaagucauucaagaguucuuuggaaaagaucccaacacaucuguagacccugaccuagcaguaguaacgggaguggcuauccaagcagggauugauggaggcucuuggccucuccaagucagugcuuuagaaauucccaauaagcauuuacaaaaaaccaacuucaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6287 - RNA, 1806 nt, Artificial Sequence
  mRNA product Design5 comprising derived and/or modified sequence from Homo sapiens__NP_057383.2__HsHSPA14 (wt)
gggagagucccgcagucggcguccagcggcucugcuuguucgugugugugucguugcaggccuuauucaagcuuaccauggcggccaucggaguucaccugggcugcaccucagccuguguggccgucuauaaggauggccgggcuggugugguugcaaaugaugccggugaccgaguuacuccagcuguuguugcuuacucagaaaaugaagagauuguuggauuggcagcaaaacaaaguagaauaagaaauauuucaaauacaguaaugaaaguaaagcagauccugggcagaagcuccagugauccacaagcucagaaauacaucgcggaaaguaaauguuuagucauugaaaaaaaugggaaauuacgauaugaaauagauacuggagaagaaacaaaauuuguuaacccagaagauguugccagacugauauuuaguaaaaugaaagaaacggcacauucuguauugggcucagaugcaaaugauguaguuauuacugucccguuugauuuuggagaaaagcaaaaaaaugcucuuggagaagcagcuagagcugcuggauuuaauguuuugcgauuaauucacgaaccgucugcagcucuucuugcuuauggaauuggacaagacuccccuacuggaaaaagcaauauuuugguguuuaagcuuggaggaacauccuuaucucucagcgucauggaaguuaacaguggaauauaucggguucuuucaacaaacacugaugauaacaucgguggugcacauuucacagaaaccuuagcacaguaucuagcuucugaguuccaaagauccuucaaacaugaugugagaggaaaugcgcgagccaugaugaaauuaacgaacagugcugaaguagcgaaacauucuuugucaaccuugggaagugccaacuguuuucuugacucauuauaugaaggucaagauuuugauugcaauguguccagagcaagauuugaacuucuuuguucuccacuuuuuaauaaguguauagaagcaaucagaggacucuuagaucaaaauggauuuacagcagaugauaucaacaagguuguccuuuguggagggucuucucgaaucccaaagcuacagcaacugauuaaagaucuuuucccagcuguugagcuucucaauucuaucccuccugaugaagugaucccuauuggugcagcuauagaagcaggaauucuuauugggaaagaaaaccuguugguggaagacucucuuaugauagaguguucagccagagauauuuuaguuaaggguguggacgaaucaggagccaguagauucacagugcuguuuccaucagggacuccuuugccagcucgaagacaacacacauugcaagccccuggaagcauaucuucagugugccuugaacucuaugagucugaugggaagaacucugccaaagaggaaaccaaguuugcacagguuguacuccaggauuuagauaaaaaagaaaauggauuacgugauauauuagcuguucuuacuaugaaaagggauggaucuuuacaugugacaugcacagaucaagaaacuggaaaaugugaagcaaucucuauugagauagcaucuuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6288 - RNA, 2853 nt, Artificial Sequence
  mRNA product Design5 comprising derived and/or modified sequence from Homo sapiens__NP_006635.2 __HsHSPH1 (wt)
gggagagucccgcagucggcguccagcggcucugcuuguucgugugugugucguugcaggccuuauucaagcuuaccaugucgguggugggguuggacgugggcucgcagagcugcuacaucgcgguagcccgggccgggggcaucgagaccaucgccaaugaguucagcgaccggugcaccccgucagucauaucauuuggaucaaaaaauagaacaaucggaguugcagccaaaaaucagcaaaucacucaugcaaacaauacggugucuaacuucaaaagauuucauggccgagcauucaaugaccccuucauucaaaaggagaaggaaaacuugaguuacgauuugguuccauugaaaaaugguggaguuggaauaaagguaauguacaugggugaagaacaucuauuuaguguggagcagauaacagccauguuguugacuaagcugaaggaaacugcugaaaacagccucaagaaaccaguaacagauuguguuauuucaguccccuccuucuuuacagaugcugagaggcgaucuguguuagaugcugcacagauuguuggccuaaacuguuuaagacuuaugaaugacaugacagcuguugcuuugaauuacggaauuuauaagcaggaucucccaagccuggaugagaaaccucggauagugguuuuuguugauaugggacauucagcuuuucaagugucugcuugugcuuuuaacaagggaaaauugaagguacugggaacagcuuuugauccuuucuuaggaggaaaaaacuucgaugaaaaguuaguggaacauuuuugugcagaauuuaaaacuaaguacaaguuggaugcaaaauccaaaauacgagcacuccuacgucuguaucaggaaugugaaaaacugaaaaagcuaaugagcucuaacagcacagaccuuccacugaauaucgaaugcuuuaugaaugauaaagauguuuccggaaagaugaacaggucacaauuugaagaacucugugcugaacuucugcaaaagauagaaguaccccuuuauucacuguuggaacaaacucaucucaaaguagaagaugugagugcaguugagauuguuggaggcgcuacacgaauuccagcugugaaggaaagaauugccaaauucuuuggaaaagauauuagcacaacacucaaugcagaugaagcaguagccagaggaugugcauuacagugugcaauacuuuccccggcauuuaaaguuagagaauuuuccgucacagaugcaguuccuuuuccaauaucucugaucuggaaccaugauucagaagauacugaagguguucaugaagucuuuagucgaaaccaugcugcuccuuucuccaaaguucucaccuuucugagaagggggccuuuugagcuagaagcuuucuauucugauccccaaggaguuccauauccagaagcaaaaauaggccgcuuuguaguucagaauguuucugcacagaaagauggagaaaaaucuagaguaaaagucaaagugcgagucaacacccauggcauuuucaccaucucuacggcaucuaugguggagaaagucccaacugaggagaaugaaaugucuucugaagcugacauggagugucugaaucagagaccaccagaaaacccagacacugauaaaaauguccagcaagacaacagugaagcuggaacacagccccagguacaaacugaugcucaacaaaccucacagucucccccuucaccugaacuuaccucagaagaaaacaaaaucccagaugcugacaaagcaaaugaaaaaaaaguugaccagccuccagaagcuaaaaagcccaaaauaaagguggugaauguugagcugccuauugaagccaacuuggucuggcaguuagggaaagaccuucuuaacauguauauugagacagaggguaagaugauaaugcaagauaaauuggaaaaagaaaggaaugaugcuaaaaaugcaguugaggaauauguguaugaguucagagacaagcuguguggaccauaugaaaaauuuauaugugagcaggaucaucaaaauuuuuugagacuccucacagaaacugaagacuggcuguaugaagaaggagaggaccaagcuaaacaagcauauguugacaaguuggaagaauuaaugaaaauuggcacuccaguuaaaguucgguuucaggaagcugaagaacggccaaaaauguuugaagaacuaggacagaggcugcagcauuaugccaagauagcagcugacuucagaaauaaggaugagaaauacaaccauauugaugagucugaaaugaaaaaaguggagaagucuguuaaugaagugauggaauggaugaauaaugucaugaaugcucaggcuaaaaagagucuugaucaggauccaguuguacgugcucaggaaauuaaaacaaaaaucaaggaauugaacaacacaugugaacccguuguaacacaaccgaaaccaaaaauugaaucacccaaacuggaaagaacuccaaauggcccaaauauugauaaaaaggaagaagauuuagaagacaaaaacaauuuuggugcugaaccuccacaucagaauggugaauguuacccuaaugagaaaaauucuguuaauauggacuuggacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6289 - RNA, 3276 nt, Artificial Sequence
  mRNA product Design5 comprising derived and/or modified sequence from Homo sapiens__NP_006380.1 __HsHYOU1 (wt)
gggagagucccgcagucggcguccagcggcucugcuuguucgugugugugucguugcaggccuuauucaagcuuaccauggcagacaaaguuaggaggcagaggccgaggaggcgagucuguugggccuugguggcugugcucuuggcagaccuguuggcacugagugauacacuggcagugaugucuguggaccugggcagugaguccaugaagguggccauugucaaaccuggagugcccauggaaauugucuugaauaaggaaucucggaggaaaacaccggugaucgugacccugaaagaaaaugaaagauucuuuggagacagugcagcaagcauggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgcagcugcaguucucaccugaggaaguguugggcaugguucucaauuauucucguucucuagcugaagauuuugcagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccagaauaucauguucuaugacaugggcucaggcagcaccguaugcaccauugugaccuaccagauggugaagacuaaggaagcugggaugcagccacagcugcagauccggggaguaggauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacagauugaaggccugauggaugauguggacuucaaggcaaaagugacucguguggaauuugaggaguugugugcagacuuguuugagcgggugccugggccuguacagcaggcccuccagagugccgaaaugagucuggaugagauugagcaggugauccugguggguggggccacucggguccccagaguucaggaggugcugcugaaggccgugggcaaggaggagcuggggaagaacaucaaugcagaugaagcagccgccaugggggcaguguaccaggcagcugcgcucagcaaagccuuuaaagugaagccauuugucguccgagaugcaguggucuaccccauccugguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggguauuuggcucccagaaucugaccacagugaagcuaaaaggggugggugacagcuucaagaaguauccugacuacgaguccaagggcaucaaggcucacuucaaccuggaugagaguggcgugcucagucuagacaggguggagucuguauuugagacacugguagaggacagcgcagaagaggaaucuacucucaccaaacuuggcaacaccauuuccagccuguuuggaggcgguaccacaccagaugccaaggagaaugguacugauacuguccaggaggaagaggagagcccugcagaggggagcaaggacgagccuggggagcagguggagcucaaggaggaagcugaggccccaguggaggauggcucucagcccccacccccugaaccuaagggagaugcaaccccugagggagaaaaggccacagaaaaagaaaauggggacaagucugaggcccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaacuucaggacuugacacuccgagaccuggagaagcaggaacgggaaaaagcugccaacagcuuggaagcauucauauuugagacccaggacaagcuguaccagcccgaguaccaggaaguguccacagaggagcagcgugaggagaucucugggaagcucagcgccgcauccaccuggcuggaggaugaggguguuggagccaccacagugauguugaaggagaagcuggcugagcugaggaagcugugccaagggcuguuuuuucggguagaggagcgcaagaaguggcccgaacggcugucugcccucgauaaucuccucaaccauuccagcauguuccucaagggggcccggcucaucccagagauggaccagaucuucacugagguggagaugacaacguuagagaaagucaucaaugagaccugggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggccagacugaagaugcagagcccauuucagaaccugagaaaguagagacuggauccgagccaggagacacugagccuuuggaguuaggagguccuggagcagaaccugaacagaaagaacaaucgacaggacagaagcggccuuugaagaacgacgaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6290 - RNA, 2475 nt, Artificial Sequence
  mRNA product Design5 comprising derived and/or modified sequence from Homo sapiens__NP_005339.3 __HsHSP90AA1 (wt)
gggagagucccgcagucggcguccagcggcucugcuuguucgugugugugucguugcaggccuuauucaagcuuaccaugccugaggaaacccagacccaagaccaaccgauggaggaggaggagguugagacguucgccuuucaggcagaaauugcccaguugaugucauugaucaucaauacuuucuacucgaacaaagagaucuuucugagagagcucauuucaaauucaucagaugcauuggacaaaauccgguaugaaagcuugacagaucccaguaaauuagacucugggaaagagcugcauauuaaccuuauaccgaacaaacaagaucgaacucucacuauuguggauacuggaauuggaaugaccaaggcugacuugaucaauaaccuugguacuaucgccaagucugggaccaaagcguucauggaagcuuugcaggcuggugcagauaucucuaugauuggccaguucgguguugguuuuuauucugcuuauuugguugcugagaaaguaacugugaucaccaaacauaacgaugaugagcaguacgcuugggaguccucagcagggggaucauucacagugaggacagacacaggugaaccuaugggucguggaacaaaaguuauccuacaccugaaagaagaccaaacugaguacuuggaggaacgaagaauaaaggagauugugaagaaacauucucaguuuauuggauaucccauuacucuuuuuguggagaaggaacgugauaaagaaguaagcgaugaugaggcugaagaaaaggaagacaaagaagaagaaaaagaaaaagaagagaaagagucggaagacaaaccugaaauugaagauguugguucugaugaggaagaagaaaagaaggauggugacaagaagaagaagaagaagauuaaggaaaaguacaucgaucaagaagagcucaacaaaacaaagcccaucuggaccagaaaucccgacgauauuacuaaugaggaguacggagaauucuauaagagcuugaccaaugacugggaagaucacuuggcagugaagcauuuuucaguugaaggacaguuggaauucagagcccuucuauuugucccacgacgugcuccuuuugaucuguuugaaaacagaaagaaaaagaacaacaucaaauuguauguacgcagaguuuucaucauggauaacugugaggagcuaaucccugaauaucugaacuucauuagaggggugguagacucggaggaucucccucuaaacauaucccgugagauguugcaacaaagcaaaauuuugaaaguuaucaggaagaauuuggucaaaaaaugcuuagaacucuuuacugaacuggcggaagauaaagagaacuacaagaaauucuaugagcaguucucuaaaaacauaaagcuuggaauacacgaagacucucaaaaucggaagaagcuuucagagcuguuaagguacuacacaucugccucuggugaugagaugguuucucucaaggacuacugcaccagaaugaaggagaaccagaaacauaucuauuauaucacaggugagaccaaggaccagguagcuaacucagccuuuguggaacgucuucggaaacauggcuuagaagugaucuauaugauugagcccauugaugaguacuguguccaacagcugaaggaauuugaggggaagacuuuagugucagucaccaaagaaggccuggaacuuccagaggaugaagaagagaaaaagaagcaggaagagaaaaaaacaaaguuugagaaccucugcaaaaucaugaaagacauauuggagaaaaaaguugaaaaggugguugugucaaaccgauuggugacaucuccaugcuguauugucacaagcacauauggcuggacagcaaacauggagagaaucaugaaagcucaagcccuaagagacaacucaacaauggguuacauggcagcaaagaaacaccuggagauaaacccugaccauuccauuauugagaccuuaaggcaaaaggcagaggcugauaagaacgacaagucugugaaggaucuggucaucuugcuuuaugaaacugcgcuccugucuucuggcuucagucuggaagauccccagacacaugcuaacaggaucuacaggaugaucaaacuuggucuggguauugaugaagaugacccuacugcugaugauaccagugcugcuguaacugaagaaaugccaccccuugaaggagaugacgacacaucacgcauggaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6291 - RNA, 615 nt, Artificial Sequence
  mRNA product Design5 comprising derived and/or modified sequence from Homo sapiens__NG_005218__HsHSP90AA3P (wt)
gggagagucccgcagucggcguccagcggcucugcuuguucgugugugugucguugcaggccuuauucaagcuuaccauggauuccaguaaauuagacucugggaaagggcugcauauuaaccuuguaccaaacaaacaaaaucaaacccucacuauuguggacacuagaauuggaaugaccaagacugacuugaucaauaaccucgguacugucaccaagucugggaccaaagcauucauggaagcuuugcaggcugaugcagauaucucuaugauuggccauuucgggguugguuuuuauucugcuuauuugguugccaagaaaguaacugugaucagcaaacauaacaaugaugagcaguacaccugggaguccucagcagggggaucauucacagugaggacagacgagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6292 - RNA, 2451 nt, Artificial Sequence
  mRNA product Design5 comprising derived and/or modified sequence from Homo sapiens__NP_031381.2__HsHSP90AB1 (wt)
gggagagucccgcagucggcguccagcggcucugcuuguucgugugugugucguugcaggccuuauucaagcuuaccaugccugaggaagugcaccauggagaggaggagguggagacuuuugccuuucaggcagaaauugcccaacucaugucccucaucaucaauaccuucuauuccaacaaggagauuuuccuucgggaguugaucucuaaugcuucugaugccuuggacaagauucgcuaugagagccugacagacccuucgaaguuggacagugguaaagagcugaaaauugacaucauccccaacccucaggaacguacccugacuuugguagacacaggcauuggcaugaccaaagcugaucucauaaauaauuugggaaccauugccaagucugguacuaaagcauucauggaggcucuucaggcuggugcagacaucuccaugauugggcaguuugguguuggcuuuuauucugccuacuugguggcagagaaagugguugugaucacaaagcacaacgaugaugaacaguaugcuugggagucuucugcuggagguuccuucacugugcgugcugaccauggugagcccauuggcagggguaccaaagugauccuccaucuuaaagaagaucagacagaguaccuagaagagaggcgggucaaagaaguagugaagaagcauucucaguucauaggcuaucccaucacccuuuauuuggagaaggaacgagagaaggaaauuagugaugaugaggcagaggaagagaaaggugagaaagaagaggaagauaaagaugaugaagaaaaacccaagaucgaagauguggguucagaugaggaggaugacagcgguaaggauaagaagaagaaaacuaagaagaucaaagagaaauacauugaucaggaagaacuaaacaagaccaagccuauuuggaccagaaacccugaugacaucacccaagaggaguauggagaauucuacaagagccucacuaaugacugggaagaccacuuggcagucaagcacuuuucuguagaaggucaguuggaauucagggcauugcuauuuauuccucgucgggcucccuuugaccuuuuugagaacaagaagaaaaagaacaacaucaaacucuauguccgccguguguucaucauggacagcugugaugaguugauaccagaguaucucaauuuuauccguggugugguugacucugaggaucugccccugaacaucucccgagaaaugcuccagcagagcaaaaucuugaaagucauucgcaaaaacauuguuaagaagugccuugagcucuucucugagcuggcagaagacaaggagaauuacaagaaauucuaugaggcauucucuaaaaaucucaagcuuggaauccacgaagacuccacuaaccgccgccgccugucugagcugcugcgcuaucauaccucccagucuggagaugagaugacaucucugucagaguauguuucucgcaugaaggagacacagaaguccaucuauuacaucacuggugagagcaaagagcagguggccaacucagcuuuuguggagcgagugcggaaacggggcuucgaggugguauauaugaccgagcccauugacgaguacugugugcagcagcucaaggaauuugaugggaagagccuggucucaguuaccaaggagggucuggagcugccugaggaugaggaggagaagaagaagauggaagagagcaaggcaaaguuugagaaccucugcaagcucaugaaagaaaucuuagauaagaagguugagaaggugacaaucuccaauagacuugugucuucaccuugcugcauugugaccagcaccuacggcuggacagccaauauggagcggaucaugaaagcccaggcacuucgggacaacuccaccaugggcuauaugauggccaaaaagcaccuggagaucaacccugaccaccccauuguggagacgcugcggcagaaggcugaggccgacaagaaugauaaggcaguuaaggaccugguggugcugcuguuugaaaccgcccugcuaucuucuggcuuuucccuugaggauccccagacccacuccaaccgcaucuaucgcaugaucaagcuaggucuagguauugaugaagaugaaguggcagcagaggaacccaaugcugcaguuccugaugagauccccccucucgagggcgaugaggaugcgucucgcauggaagaagucgauuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6293 - RNA, 2688 nt, Artificial Sequence
  mRNA product Design5 comprising derived and/or modified sequence from Homo sapiens__NP_003290.1__HsHSP90B1 (wt)
gggagagucccgcagucggcguccagcggcucugcuuguucgugugugugucguugcaggccuuauucaagcuuaccaugagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcuuucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcuuguucguaaaacgcuggacaugaucaagaagauugcugaugauaaauacaaugauacuuuuuggaaagaauuugguaccaacaucaagcuuggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagagcccgaagaagaaccugaagagacagcagaagacacaacagaagacacagagcaagacgaagaugaagaaauggaugugggaacagaugaagaagaagaaacagcaaaggaaucuacagcugaaaaagaugaauuguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6294 - RNA, 2391 nt, Artificial Sequence
  mRNA product Design5 comprising derived and/or modified sequence from Homo sapiens__NP_057376.2__HsTRAP1 (wt)
gggagagucccgcagucggcguccagcggcucugcuuguucgugugugugucguugcaggccuuauucaagcuuaccauggcgcgcgagcugcgggcgcugcugcuguggggccgccgccugcggccuuugcugcgggcgccggcgcuggcggccgugccgggaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguuccacuuccaaacaugaguuccaggccgagacaaagaagcuuuuggacauuguugcccggucccuguacucagaaaaagagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccaggauacugguaucgggaugacacaggaagagcugguguccaaccuggggacgauugccagaucggggucaaaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugguucuggaguguuugaaaucgccgaagcuucgggaguuagaaccgggacaaaaaucaucauccaccugaaauccgacugcaaggaguuuuccagcgaggcccgggugcgagaugugguaacgaaguacagcaacuucgucagcuuccccuuguacuugaauggaaggcggaugaacaccuugcaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacaugaaaccguccauguuugaugugagccgggagcugggcuccagcguugcacuguacagccgcaaaguccucauccagaccaaggccacggacauccugcccaaguggcugcgcuucauccgaggugugguggacagugaggacauuccccugaaccucagccgggagcugcugcaggagagcgcacucaucaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagagguucucuucugcuuugagcaguuugaugagcucacccugcugcaccuucgugaguuugacaagaagaagcugaucucuguggagacggacauagucguggaucacuacaaggaggagaaguuugaggacagguccccagccgccgagugccuaucagagaaggagacggaggagcucauggccuggaugagaaaugugcuggggucgcgugucaccaacgugaaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggcacgcgcucaucaagaagcugaaucagcugcgcgcaagcgagccuggccuggcucagcugcugguggaucagauauacgagaacgccaugauugcugcuggacuuguugacgacccuagggccauggugggccgcuugaaugagcugcuugucaaggcccuggagcgacacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6295 - RNA, 738 nt, Artificial Sequence
  mRNA product Design5 comprising derived and/or modified sequence from Homo sapiens__NP_000609.1__HsIGF1 (wt)
gggagagucccgcagucggcguccagcggcucugcuuguucgugugugugucguugcaggccuuauucaagcuuaccaugggaaaaaucagcagucuuccaacccaauuauuuaagugcugcuuuugugauuucuugaaggugaagaugcacaccauguccuccucgcaucucuucuaccuggcgcugugccugcucaccuucaccagcucugccacggcuggaccggagacgcucugcggggcugagcugguggaugcucuucaguucguguguggagacaggggcuuuuauuucaacaagcccacaggguauggcuccagcagucggagggcgccucagacaggcaucguggaugagugcugcuuccggagcugugaucuaaggaggcuggagauguauugcgcaccccucaagccugccaagucagcucgcucuguccgugcccagcgccacaccgacaugcccaagacccagaaggaaguacauuugaagaacgcaaguagagggagugcaggaaacaagaacuacaggauguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6296 - RNA, 819 nt, Artificial Sequence
  mRNA product Design5 comprising derived and/or modified sequence from Homo sapiens__NP_000603.1__HsIGF2 (wt)
gggagagucccgcagucggcguccagcggcucugcuuguucgugugugugucguugcaggccuuauucaagcuuaccaugggaaucccaauggggaagucgaugcuggugcuucucaccuucuuggccuucgccucgugcugcauugcugcuuaccgccccagugagacccugugcggcggggagcugguggacacccuccaguucgucuguggggaccgcggcuucuacuucagcaggcccgcaagccgugugagccgucgcagccguggcaucguugaggagugcuguuuccgcagcugugaccuggcccuccuggagacguacugugcuacccccgccaaguccgagagggacgugucgaccccuccgaccgugcuuccggacaacuuccccagauaccccgugggcaaguucuuccaauaugacaccuggaagcaguccacccagcgccugcgcaggggccugccugcccuccugcgugcccgccggggucacgugcucgccaaggagcucgaggcguucagggaggccaaacgucaccguccccugauugcucuacccacccaagaccccgcccacgggggcgcccccccagagauggccagcaaucggaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6297 - RNA, 915 nt, Artificial Sequence
  mRNA product Design5 comprising derived and/or modified sequence from Homo sapiens__NP_000591.1__HsIL6 (wt)
gggagagucccgcagucggcguccagcggcucugcuuguucgugugugugucguugcaggccuuauucaagcuuaccaugaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcugugcagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucuucggcaaauguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6298 - RNA, 1557 nt, Artificial Sequence
  mRNA product Design5 comprising derived and/or modified sequence from Homo sapiens__NP_002183.1__HsINHBA (wt)
gggagagucccgcagucggcguccagcggcucugcuuguucgugugugugucguugcaggccuuauucaagcuuaccaugcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcuucaugugggcaaagucggggagaacggguauguggagauagaggaugacauuggaaggagggcagaaaugaaugaacuuauggagcagaccucggagaucaucacguuugccgagucaggaacagccaggaagacgcugcacuucgagauuuccaaggaaggcagugaccugucagugguggagcgugcagaagucuggcucuuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaagagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6299 - RNA, 1500 nt, Artificial Sequence
  mRNA product Design5 comprising derived and/or modified sequence from Homo sapiens__NP_002184.2__HsINHBB (wt)
gggagagucccgcagucggcguccagcggcucugcuuguucgugugugugucguugcaggccuuauucaagcuuaccauggacgggcugcccggucgggcgcugggggccgccugccuucugcugcuggcggccggcuggcuggggccugaggccuggggcucacccacgcccccgccgacgccugccgcgccgccgccacccccgccacccggauccccggguggcucgcaggacaccuguacgucgugcggcggcuuccggcggccagaggagcucggccgaguggacggcgacuuccuggaggcggugaagcggcacaucuugagccgccugcagaugcggggccggcccaacaucacgcacgccgugccuaaggccgccauggucacggcccugcgcaagcugcacgcgggcaaggugcgcgaggacggccgcguggagaucccgcaccucgacggccacgccagcccgggcgccgacggccaggagcgcguuuccgaaaucaucagcuucgccgagacagauggccucgccuccucccggguccgccuauacuucuucaucuccaacgaaggcaaccagaaccuguuugugguccaggccagccuguggcuuuaccugaaacuccugcccuacguccuggagaagggcagccggcggaaggugcgggucaaaguguacuuccaggagcagggccacggugacagguggaacaugguggagaagaggguggaccucaagcgcagcggcuggcauaccuucccacucacggaggccauccaggccuuguuugagcggggcgagcggcgacucaaccuagacgugcagugugacagcugccaggagcuggccguggugccgguguucguggacccaggcgaagagucgcaccggcccuuugugguggugcaggcucggcugggcgacagcaggcaccgcauucgcaagcgaggccuggagugcgauggccggaccaaccucuguugcaggcaacaguucuucauugacuuccgccucaucggcuggaacgacuggaucauagcacccaccggcuacuacgggaacuacugugagggcagcugcccagccuaccuggcagggguccccggcucugccuccuccuuccacacggcuguggugaaccaguaccgcaugcggggucugaaccccggcacggugaacuccugcugcauucccaccaagcugagcaccauguccaugcuguacuucgaugaugaguacaacaucgucaagcgggacgugcccaacaugauuguggaggagugcggcugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6300 - RNA, 3735 nt, Artificial Sequence
  mRNA product Design5 comprising derived and/or modified sequence from Homo sapiens__NP_000623.2__HsITGAM (wt)
gggagagucccgcagucggcguccagcggcucugcuuguucgugugugugucguugcaggccuuauucaagcuuaccauggcucucagaguccuucuguuaacagccuugaccuuaugucauggguucaacuuggacacugaaaacgcaaugaccuuccaagagaacgcaaggggcuucgggcagagcgugguccagcuucagggauccaggguggugguuggagccccccaggagauaguggcugccaaccaaaggggcagccucuaccagugcgacuacagcacaggcucaugcgagcccauccgccugcagguccccguggaggccgugaacaugucccugggccugucccuggcagccaccaccagccccccucagcugcuggccuguggucccaccgugcaccagacuugcagugagaacacguaugugaaagggcucugcuuccuguuuggauccaaccuacggcagcagccccagaaguucccagaggcccuccgaggguguccucaagaggauagugacauugccuucuugauugauggcucugguagcaucaucccacaugacuuucggcggaugaaggaguuugucucaacugugauggagcaauuaaaaaaguccaaaaccuuguucucuuugaugcaguacucugaagaauuccggauucacuuuaccuucaaagaguuccagaacaacccuaacccaagaucacuggugaagccaauaacgcagcugcuugggcggacacacacggccacgggcauccgcaaagugguacgagagcuguuuaacaucaccaacggagcccgaaagaaugccuuuaagauccuaguugucaucacggauggagaaaaguuuggcgaucccuugggauaugaggaugucaucccugaggcagacagagagggagucauucgcuacgucauuggggugggagaugccuuccgcagugagaaaucccgccaagagcuuaauaccaucgcauccaagccgccucgugaucacguguuccaggugaauaacuuugaggcucugaagaccauucagaaccagcuucgggagaagaucuuugcgaucgaggguacucagacaggaaguagcagcuccuuugagcaugagaugucucaggaaggcuucagcgcugccaucaccucuaauggccccuugcugagcacuguggggagcuaugacugggcugguggagucuuucuauauacaucaaaggagaaaagcaccuucaucaacaugaccagaguggauucagacaugaaugaugcuuacuuggguuaugcugccgccaucaucuuacggaaccgggugcaaagccugguucugggggcaccucgauaucagcacaucggccugguagcgauguucaggcagaacacuggcaugugggaguccaacgcuaaugucaagggcacccagaucggcgccuacuucggggccucccucugcuccguggacguggacagcaacggcagcaccgaccugguccucaucggggccccccauuacuacgagcagacccgagggggccagguguccgugugccccuugcccagggggagggcucgguggcagugugaugcuguucucuacggggagcagggccaacccuggggccgcuuuggggcagcccuaacagugcugggggacguaaauggggacaagcugacggacguggccauuggggccccaggagaggaggacaaccggggugcuguuuaccuguuucacggaaccucaggaucuggcaucagccccucccauagccagcggauagcaggcuccaagcucucucccaggcuccaguauuuuggucagucacugagugggggccaggaccucacaauggauggacugguagaccugacuguaggagcccaggggcacgugcugcugcucaggucccagccaguacugagagucaaggcaaucauggaguucaaucccagggaaguggcaaggaauguauuugaguguaaugaucagguggugaaaggcaaggaagccggagaggucagagucugccuccauguccagaagagcacacgggaucggcuaagagaaggacagauccagaguguugugacuuaugaccuggcucuggacuccggccgcccacauucccgcgccgucuucaaugagacaaagaacagcacacgcagacagacacaggucuuggggcugacccagacuugugagacccugaaacuacaguugccgaauugcaucgaggacccagugagccccauugugcugcgccugaacuucucucuggugggaacgccauugucugcuuucgggaaccuccggccagugcuggcggaggaugcucagagacucuucacagccuuguuucccuuugagaagaauuguggcaaugacaacaucugccaggaugaccucagcaucaccuucaguuucaugagccuggacugccucguggugggugggccccgggaguucaacgugacagugacugugagaaaugauggugaggacuccuacaggacacaggucaccuucuucuucccgcuugaccuguccuaccggaagguguccacgcuccagaaccagcgcucacagcgauccuggcgccuggccugugagucugccuccuccaccgaagugucuggggccuugaagagcaccagcugcagcauaaaccaccccaucuucccggaaaacucagaggucaccuuuaauaucacguuugauguagacucuaaggcuucccuuggaaacaaacugcuccucaaggccaaugugaccagugagaacaacaugcccagaaccaacaaaaccgaauuccaacuggagcugccggugaaauaugcugucuacaugguggucaccagccauggggucuccacuaaauaucucaacuucacggccucagagaauaccagucgggucaugcagcaucaauaucaggucagcaaccuggggcagaggagccuccccaucagccugguguucuuggugcccguccggcugaaccagacugucauaugggaccgcccccaggucaccuucuccgagaaccucucgaguacgugccacaccaaggagcgcuugcccucucacuccgacuuucuggcugagcuucggaaggcccccguggugaacugcuccaucgcugucugccagagaauccagugugacaucccguucuuuggcauccaggaagaauucaaugcuacccucaaaggcaaccucucguuugacugguacaucaagaccucgcauaaccaccuccugaucgugagcacagcugagaucuuguuuaacgauuccguguucacccugcugccgggacagggggcguuugugaggucccagacggagaccaaaguggagccguucgagguccccaacccccugccgcucaucgugggcagcucugucgggggacugcugcuccuggcccucaucaccgccgcgcuguacaagcucggcuucuucaagcggcaauacaaggacaugaugagugaagggggucccccgggggccgaaccccaguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6301 - RNA, 1680 nt, Artificial Sequence
  mRNA product Design5 comprising derived and/or modified sequence from Homo sapiens__NP_002415.1__HsMMP8 (wt)
gggagagucccgcagucggcguccagcggcucugcuuguucgugugugugucguugcaggccuuauucaagcuuaccauguucucccugaagacgcuuccauuucugcucuuacuccaugugcagauuuccaaggccuuuccuguaucuucuaaagagaaaaauacaaaaacuguucaggacuaccuggaaaaguucuaccaauuaccaagcaaccaguaucagucuacaaggaagaauggcacuaaugugaucguugaaaagcuuaaagaaaugcagcgauuuuuuggguugaaugugacggggaagccaaaugaggaaacucuggacaugaugaaaaagccucgcuguggagugccugacaguggugguuuuauguuaaccccaggaaaccccaagugggaacgcacuaacuugaccuacaggauucgaaacuauaccccacagcugucagaggcugagguagaaagagcuaucaaggaugccuuugaacucuggaguguugcaucaccucucaucuucaccaggaucucacagggagaggcagauaucaacauugcuuuuuaccaaagagaucacggugacaauucuccauuugauggacccaauggaauccuugcucaugccuuucagccaggccaagguauuggaggagaugcucauuuugaugccgaagaaacauggaccaacaccuccgcaaauuacaacuuguuucuuguugcugcucaugaauuuggccauucuuuggggcucgcucacuccucugacccuggugccuugauguaucccaacuaugcuuucagggaaaccagcaacuacucacucccucaagaugacaucgauggcauucaggccaucuauggacuuucaagcaacccuauccaaccuacuggaccaagcacacccaaacccugugaccccaguuugacauuugaugcuaucaccacacuccguggagaaauacuuuucuuuaaagacagguacuucuggagaaggcauccucagcuacaaagagucgaaaugaauuuuauuucucuauucuggccaucccuuccaacugguauacaggcugcuuaugaagauuuugacagagaccucauuuuccuauuuaaaggcaaccaauacugggcucugaguggcuaugauauucugcaagguuaucccaaggauauaucaaacuauggcuuccccagcagcguccaagcaauugacgcagcuguuuucuacagaaguaaaacauacuucuuuguaaaugaccaauucuggagauaugauaaccaaagacaauucauggagccagguuaucccaaaagcauaucaggugccuuuccaggaauagagaguaaaguugaugcaguuuuccagcaagaacauuucuuccaugucuucaguggaccaagauauuacgcauuugaucuuauugcucagagaguuaccagaguugcaagaggcaauaaauggcuuaacuguagauauggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6302 - RNA, 2400 nt, Artificial Sequence
  mRNA product Design5 comprising derived and/or modified sequence from Homo sapiens__NP_004985.2__HsMMP9 (wt)
gggagagucccgcagucggcguccagcggcucugcuuguucgugugugugucguugcaggccuuauucaagcuuaccaugagccucuggcagccccugguccuggugcuccuggugcugggcugcugcuuugcugcccccagacagcgccaguccacccuugugcucuucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcucuucggcuucugcccgacccgagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuuuucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6303 - RNA, 1692 nt, Artificial Sequence
  mRNA product Design5 comprising derived and/or modified sequence from Homo sapiens__NP_002418.1__HsMMP13 (wt)
gggagagucccgcagucggcguccagcggcucugcuuguucgugugugugucguugcaggccuuauucaagcuuaccaugcauccagggguccuggcugccuuccucuucuugagcuggacucauugucgggcccugccccuucccagugguggugaugaagaugauuugucugaggaagaccuccaguuugcagagcgcuaccugagaucauacuaccauccuacaaaucucgcgggaauccugaaggagaaugcagcaagcuccaugacugagaggcuccgagaaaugcagucuuucuucggcuuagaggugacuggcaaacuugacgauaacaccuuagaugucaugaaaaagccaagaugcgggguuccugaugugggugaauacaauguuuucccucgaacucuuaaaugguccaaaaugaauuuaaccuacagaauugugaauuacaccccugauaugacucauucugaagucgaaaaggcauucaaaaaagccuucaaaguuugguccgauguaacuccucugaauuuuaccagacuucacgauggcauugcugacaucaugaucucuuuuggaauuaaggagcauggcgacuucuacccauuugaugggcccucuggccugcuggcucaugcuuuuccuccugggccaaauuauggaggagaugcccauuuugaugaugaugaaaccuggacaaguaguuccaaaggcuacaacuuguuucuuguugcugcgcaugaguucggccacuccuuaggucuugaccacuccaaggacccuggagcacucauguuuccuaucuacaccuacaccggcaaaagccacuuuaugcuuccugaugacgauguacaagggauccagucucucuaugguccaggagaugaagaccccaacccuaaacauccaaaaacgccagacaaaugugacccuuccuuaucccuugaugccauuaccagucuccgaggagaaacaaugaucuuuaaagacagauucuucuggcgccugcauccucagcagguugaugcggagcuguuuuuaacgaaaucauuuuggccagaacuucccaaccguauugaugcugcauaugagcacccuucucaugaccucaucuucaucuucagagguagaaaauuuugggcucuuaaugguuaugacauucuggaagguuaucccaaaaaaauaucugaacugggucuuccaaaagaaguuaagaagauaagugcagcuguucacuuugaggauacaggcaagacucuccuguucucaggaaaccaggucuggagauaugaugauacuaaccauauuauggauaaagacuauccgagacuaauagaagaagacuucccaggaauuggugauaaaguagaugcugucuaugagaaaaaugguuauaucuauuuuuucaacggacccauacaguuugaauacagcaucuggaguaaccguauuguucgcgucaugccagcaaauuccauuuugugguguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6304 - RNA, 1344 nt, Artificial Sequence
  mRNA product Design5 comprising derived and/or modified sequence from Homo sapiens__NP_001286.1__HsCCR1 (wt)
gggagagucccgcagucggcguccagcggcucugcuuguucgugugugugucguugcaggccuuauucaagcuuaccauggaaacuccaaacaccacagaggacuaugacacgaccacagaguuugacuauggggaugcaacuccgugccagaaggugaacgagagggccuuuggggcccaacugcugcccccucuguacuccuugguauuugucauuggccugguuggaaacauccuggugguccugguccuugugcaauacaagaggcuaaaaaacaugaccagcaucuaccuccugaaccuggccauuucugaccugcucuuccuguucacgcuucccuucuggaucgacuacaaguugaaggaugacuggguuuuuggugaugccauguguaagauccucucuggguuuuauuacacaggcuuguacagcgagaucuuuuucaucauccugcugacgauugacagguaccuggccaucguccacgccguguuugccuugcgggcacggaccgucacuuuuggugucaucaccagcaucaucauuugggcccuggccaucuuggcuuccaugccaggcuuauacuuuuccaagacccaaugggaauucacucaccacaccugcagccuucacuuuccucacgaaagccuacgagaguggaagcuguuucaggcucugaaacugaaccucuuugggcugguauugccuuuguuggucaugaucaucugcuacacagggauuauaaagauucugcuaagacgaccaaaugagaagaaauccaaagcuguccguuugauuuuugucaucaugaucaucuuuuuucucuuuuggacccccuacaauuugacuauacuuauuucuguuuuccaagacuuccuguucacccaugagugugagcagagcagacauuuggaccuggcugugcaagugacggaggugaucgccuacacgcacugcugugucaacccagugaucuacgccuucguuggugagagguuccggaaguaccugcggcaguuguuccacaggcguguggcugugcaccugguuaaauggcuccccuuccucuccguggacaggcuggagagggucagcuccacaucucccuccacaggggagcaugaacucucugcuggguucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6305 - RNA, 912 nt, Artificial Sequence
  mRNA product Design5 comprising derived and/or modified sequence from Homo sapiens__NP_002598.4__HsPDGFA (wt)
gggagagucccgcagucggcguccagcggcucugcuuguucgugugugugucguugcaggccuuauucaagcuuaccaugaggaccuuggcuugccugcugcuccucggcugcggauaccucgcccauguucuggccgaggaagccgagaucccccgcgaggugaucgagaggcuggcccgcagucagauccacagcauccgggaccuccagcgacuccuggagauagacuccguagggagugaggauucuuuggacaccagccugagagcucacgggguccaugccacuaagcaugugcccgagaagcggccccugcccauucggaggaagagaagcaucgaggaagcuguccccgcugucugcaagaccaggacggucauuuacgagauuccucggagucaggucgaccccacguccgccaacuuccugaucuggcccccgugcguggaggugaaacgcugcaccggcugcugcaacacgagcagugucaagugccagcccucccgcguccaccaccgcagcgucaagguggccaagguggaauacgucaggaagaagccaaaauuaaaagaaguccaggugagguuagaggagcauuuggagugcgccugcgcgaccacaagccugaauccggauuaucgggaagaggacacgggaaggccuagggagucagguaaaaaacggaaaagaaaaagguuaaaacccaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6306 - RNA, 1002 nt, Artificial Sequence
  mRNA product Design5 comprising derived and/or modified sequence from Homo sapiens__NP_002599.1__HsPDGFB (wt)
gggagagucccgcagucggcguccagcggcucugcuuguucgugugugugucguugcaggccuuauucaagcuuaccaugaaucgcugcugggcgcucuuccugucucucugcugcuaccugcgucuggucagcgccgagggggaccccauucccgaggagcuuuaugagaugcugagugaccacucgauccgcuccuuugaugaucuccaacgccugcugcacggagaccccggagaggaagauggggccgaguuggaccugaacaugacccgcucccacucuggaggcgagcuggagagcuuggcucguggaagaaggagccuggguucccugaccauugcugagccggccaugaucgccgagugcaagacgcgcaccgagguguucgagaucucccggcgccucauagaccgcaccaacgccaacuuccugguguggccgcccuguguggaggugcagcgcugcuccggcugcugcaacaaccgcaacgugcagugccgccccacccaggugcagcugcgaccuguccaggugagaaagaucgagauugugcggaagaagccaaucuuuaagaaggccacggugacgcuggaagaccaccuggcaugcaagugugagacaguggcagcugcacggccugugacccgaagcccgggggguucccaggagcagcgagccaaaacgccccaaacucgggugaccauucggacggugcgaguccgccggccccccaagggcaagcaccggaaauucaagcacacgcaugacaagacggcacugaaggagacccuuggagccuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6307 - RNA, 1314 nt, Artificial Sequence
  mRNA product Design5 comprising derived and/or modified sequence from Homo sapiens__NP_057289.1__HsPDGFC (wt)
gggagagucccgcagucggcguccagcggcucugcuuguucgugugugugucguugcaggccuuauucaagcuuaccaugagccucuucgggcuucuccugcugacaucugcccuggccggccagagacaggggacucaggcggaauccaaccugaguaguaaauuccaguuuuccagcaacaaggaacagaacggaguacaagauccucagcaugagagaauuauuacugugucuacuaauggaaguauucacagcccaagguuuccucauacuuauccaagaaauacggucuugguauggagauuaguagcaguagaggaaaauguauggauacaacuuacguuugaugaaagauuugggcuugaagacccagaagaugacauaugcaaguaugauuuuguagaaguugaggaacccagugauggaacuauauuagggcgcuggugugguucugguacuguaccaggaaaacagauuucuaaaggaaaucaaauuaggauaagauuuguaucugaugaauauuuuccuucugaaccaggguucugcauccacuacaacauugucaugccacaauucacagaagcugugaguccuucagugcuacccccuucagcuuugccacuggaccugcuuaauaaugcuauaacugccuuuaguaccuuggaagaccuuauucgauaucuugaaccagagagauggcaguuggacuuagaagaucuauauaggccaacuuggcaacuucuuggcaaggcuuuuguuuuuggaagaaaauccagagugguggaucugaaccuucuaacagaggagguaagauuauacagcugcacaccucguaacuucucaguguccauaagggaagaacuaaagagaaccgauaccauuuucuggccagguugucuccugguuaaacgcuguggugggaacugugccuguugucuccacaauugcaaugaaugucaaugugucccaagcaaaguuacuaaaaaauaccacgagguccuucaguugagaccaaagaccggugucaggggauugcacaaaucacucaccgacguggcccuggagcaccaugaggagugugacugugugugcagagggagcacaggaggauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6308 - RNA, 1371 nt, Artificial Sequence
  mRNA product Design5 comprising derived and/or modified sequence from Homo sapiens__NP_149126.1__HsPDGFD (wt)
gggagagucccgcagucggcguccagcggcucugcuuguucgugugugugucguugcaggccuuauucaagcuuaccaugcaccggcucaucuuugucuacacucuaaucugcgcaaacuuuugcagcugucgggacacuucugcaaccccgcagagcgcauccaucaaagcuuugcgcaacgccaaccucaggcgagaugacuuguaccgaagagaugagaccauccaggugaaaggaaacggcuacgugcagaguccuagauucccgaacagcuaccccaggaaccugcuccugacauggcggcuucacucucaggagaauacacggauacagcuaguguuugacaaucaguuuggauuagaggaagcagaaaaugauaucuguagguaugauuuuguggaaguugaagauauauccgaaaccaguaccauuauuagaggacgaugguguggacacaaggaaguuccuccaaggauaaaaucaagaacgaaccaaauuaaaaucacauucaaguccgaugacuacuuuguggcuaaaccuggauucaagauuuauuauucuuugcuggaagauuuccaacccgcagcagcuucagagaccaacugggaaucugucacaagcucuauuucagggguauccuauaacucuccaucaguaacggaucccacucugauugcggaugcucuggacaaaaaaauugcagaauuugauacaguggaagaucugcucaaguacuucaauccagagucauggcaagaagaucuugagaauauguaucuggacaccccucgguaucgaggcaggucauaccaugaccggaagucaaaaguugaccuggauaggcucaaugaugaugccaagcguuacaguugcacucccaggaauuacucggucaauauaagagaagagcugaaguuggccaauguggucuucuuuccacguugccuccucgugcagcgcuguggaggaaauuguggcuguggaacugucaacuggagguccugcacaugcaauucagggaaaaccgugaaaaaguaucaugagguauuacaguuugagccuggccacaucaagaggagggguagagcuaagaccauggcucuaguugacauccaguuggaucaccaugaacgaugugauuguaucugcagcucaagaccaccucgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6309 - RNA, 954 nt, Artificial Sequence
  mRNA product Design5 comprising derived and/or modified sequence from Homo sapiens__NP_003946.3__HsSOCS3 (wt)
gggagagucccgcagucggcguccagcggcucugcuuguucgugugugugucguugcaggccuuauucaagcuuaccauggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagagccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6310 - RNA, 759 nt, Artificial Sequence
  mRNA product Design5 comprising derived and/or modified sequence from Homo sapiens__NP_003227.1__HsTGFA (wt)
gggagagucccgcagucggcguccagcggcucugcuuguucgugugugugucguugcaggccuuauucaagcuuaccaugguccccucggcuggacagcucgcccuguucgcucuggguauuguguuggcugcgugccaggccuuggagaacagcacguccccgcugagugcagacccgcccguggcugcagcaguggugucccauuuuaaugacugcccagauucccacacucaguucugcuuccauggaaccugcagguuuuuggugcaggaggacaagccagcaugugucugccauucuggguacguuggugcacgcugugagcaugcggaccuccuggccgugguggcugccagccagaagaagcaggccaucaccgccuuggugguggucuccaucguggcccuggcuguccuuaucaucacaugugugcugauacacugcugccagguccgaaaacacugugaguggugccgggcccucaucugccggcacgagaagcccagcgcccuccugaagggaagaaccgcuugcugccacucagaaacaguggucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6311 - RNA, 1449 nt, Artificial Sequence
  mRNA product Design5 comprising derived and/or modified sequence from Homo sapiens__NP_000651.3__HsTGFB1 (wt)
gggagagucccgcagucggcguccagcggcucugcuuguucgugugugugucguugcaggccuuauucaagcuuaccaugccgcccuccgggcugcggcugcugccgcugcugcuaccgcugcuguggcuacuggugcugacgccuggccggccggccgcgggacuauccaccugcaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacgaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccagaaauacagcaacaauuccuggcgauaccucagcaaccggcugcuggcacccagcgacucgccagagugguuaucuuuugaugucaccggaguugugcggcagugguugagccguggaggggaaauugagggcuuucgccuuagcgcccacugcuccugugacagcagggauaacacacugcaaguggacaucaacggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6312 - RNA, 1521 nt, Artificial Sequence
  mRNA product Design5 comprising derived and/or modified sequence from Homo sapiens__NP_003229.1__HsTGFB2 (wt)
gggagagucccgcagucggcguccagcggcucugcuuguucgugugugugucguugcaggccuuauucaagcuuaccaugcacuacugugugcugagcgcuuuucugauccugcaucuggucacggucgcgcucagccugucuaccugcagcacacucgauauggaccaguucaugcgcaagaggaucgaggcgauccgcgggcagauccugagcaagcugaagcucaccagucccccagaagacuauccugagcccgaggaaguccccccggaggugauuuccaucuacaacagcaccagggacuugcuccaggagaaggcgagccggagggcggccgccugcgagcgcgagaggagcgacgaagaguacuacgccaaggagguuuacaaaauagacaugccgcccuucuuccccuccgaaaaugccaucccgcccacuuucuacagacccuacuucagaauuguucgauuugacgucucagcaauggagaagaaugcuuccaauuuggugaaagcagaguucagagucuuucguuugcagaacccaaaagccagagugccugaacaacggauugagcuauaucagauucucaaguccaaagauuuaacaucuccaacccagcgcuacaucgacagcaaaguugugaaaacaagagcagaaggcgaauggcucuccuucgauguaacugaugcuguucaugaauggcuucaccauaaagacaggaaccugggauuuaaaauaagcuuacacugucccugcugcacuuuuguaccaucuaauaauuacaucaucccaaauaaaagugaagaacuagaagcaagauuugcagguauugauggcaccuccacauauaccaguggugaucagaaaacuauaaaguccacuaggaaaaaaaacagugggaagaccccacaucuccugcuaauguuauugcccuccuacagacuugagucacaacagaccaaccggcggaagaagcgugcuuuggaugcggccuauugcuuuagaaaugugcaggauaauugcugccuacguccacuuuacauugauuucaagagggaucuaggguggaaauggauacacgaacccaaaggguacaaugccaacuucugugcuggagcaugcccguauuuauggaguucagacacucagcacagcaggguccugagcuuauauaauaccauaaauccagaagcaucugcuucuccuugcugcgugucccaagauuuagaaccucuaaccauucucuacuacauuggcaaaacacccaagauugaacagcuuucuaauaugauuguaaagucuugcaaaugcagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6313 - RNA, 1515 nt, Artificial Sequence
  mRNA product Design5 comprising derived and/or modified sequence from Homo sapiens__NP_003230.1__HsTGFB3 (wt)
gggagagucccgcagucggcguccagcggcucugcuuguucgugugugugucguugcaggccuuauucaagcuuaccaugaagaugcacuugcaaagggcucuggugguccuggcccugcugaacuuugccacggucagccucucucuguccacuugcaccaccuuggacuucggccacaucaagaagaagaggguggaagccauuaggggacagaucuugagcaagcucaggcucaccagccccccugagccaacggugaugacccacguccccuaucagguccuggcccuuuacaacagcacccgggagcugcuggaggagaugcauggggagagggaggaaggcugcacccaggaaaacaccgagucggaauacuaugccaaagaaauccauaaauucgacaugauccaggggcuggcggagcacaacgaacuggcugucugcccuaaaggaauuaccuccaagguuuuccgcuucaauguguccucaguggagaaaaauagaaccaaccuauuccgagcagaauuccgggucuugcgggugcccaaccccagcucuaagcggaaugagcagaggaucgagcucuuccagauccuucggccagaugagcacauugccaaacagcgcuauaucgguggcaagaaucugcccacacggggcacugccgaguggcuguccuuugaugucacugacacugugcgugaguggcuguugagaagagaguccaacuuaggucuagaaaucagcauucacuguccaugucacaccuuucagcccaauggagauauccuggaaaacauucacgaggugauggaaaucaaauucaaaggcguggacaaugaggaugaccauggccguggagaucuggggcgccucaagaagcagaaggaucaccacaacccucaucuaauccucaugaugauucccccacaccggcucgacaacccgggccaggggggucagaggaagaagcgggcuuuggacaccaauuacugcuuccgcaacuuggaggagaacugcugugugcgcccccucuacauugacuuccgacaggaucugggcuggaaguggguccaugaaccuaagggcuacuaugccaacuucugcucaggcccuugcccauaccuccgcagugcagacacaacccacagcacggugcugggacuguacaacacucugaacccugaagcaucugccucgccuugcugcgugccccaggaccuggagccccugaccauccuguacuauguugggaggacccccaaaguggagcagcucuccaacaugguggugaagucuuguaaauguagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6314 - RNA, 1662 nt, Artificial Sequence
  mRNA product Design5 comprising derived and/or modified sequence from Homo sapiens__NP_001057.1__HsTNFRSF1B (wt)
gggagagucccgcagucggcguccagcggcucugcuuguucgugugugugucguugcaggccuuauucaagcuuaccauggcgcccgucgccgucugggccgcgcuggccgucggacuggagcucugggcugcggcgcacgccuugcccgcccagguggcauuuacacccuacgccccggagcccgggagcacaugccggcucagagaauacuaugaccagacagcucagaugugcugcagcaaaugcucgccgggccaacaugcaaaagucuucuguaccaagaccucggacaccgugugugacuccugugaggacagcacauacacccagcucuggaacuggguucccgagugcuugagcuguggcucccgcuguagcucugaccagguggaaacucaagccugcacucgggaacagaaccgcaucugcaccugcaggcccggcugguacugcgcgcugagcaagcaggaggggugccggcugugcgcgccgcugcgcaagugccgcccgggcuucggcguggccagaccaggaacugaaacaucagacguggugugcaagcccugugccccggggacguucuccaacacgacuucauccacggauauuugcaggccccaccagaucuguaacgugguggccaucccugggaaugcaagcauggaugcagucugcacguccacgucccccacccggaguauggccccaggggcaguacacuuaccccagccaguguccacacgaucccaacacacgcagccaacuccagaacccagcacugcuccaagcaccuccuuccugcucccaaugggccccagccccccagcugaagggagcacuggcgacuucgcucuuccaguuggacugauugugggugugacagccuugggucuacuaauaauaggaguggugaacugugucaucaugacccaggugaaaaagaagcccuugugccugcagagagaagccaaggugccucacuugccugccgauaaggcccgggguacacagggccccgagcagcagcaccugcugaucacagcgccgagcuccagcagcagcucccuggagagcucggccagugcguuggacagaagggcgcccacucggaaccagccacaggcaccaggcguggaggccaguggggccggggaggcccgggccagcaccgggagcucagauucuuccccugguggccaugggacccaggucaaugucaccugcaucgugaacgucuguagcagcucugaccacagcucacagugcuccucccaagccagcuccacaaugggagacacagauuccagccccucggaguccccgaaggacgagcagguccccuucuccaaggaggaaugugccuuucggucacagcuggagacgccagagacccugcuggggagcaccgaagagaagccccugccccuuggagugccugaugcugggaugaagcccaguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6315 - RNA, 789 nt, Artificial Sequence
  mRNA product Design5 comprising derived and/or modified sequence from Homo sapiens__NP_002623.2__HsPGF (wt)
gggagagucccgcagucggcguccagcggcucugcuuguucgugugugugucguugcaggccuuauucaagcuuaccaugccggucaugaggcuguucccuugcuuccugcagcuccuggccgggcuggcgcugccugcugugcccccccagcagugggccuugucugcugggaacggcucgucagagguggaagugguacccuuccaggaaguguggggccgcagcuacugccgggcgcuggagaggcugguggacgucguguccgaguaccccagcgagguggagcacauguucagcccauccugugucucccugcugcgcugcaccggcugcugcggcgaugagaaucugcacugugugccgguggagacggccaaugucaccaugcagcuccuaaagauccguucuggggaccggcccuccuacguggagcugacguucucucagcacguucgcugcgaaugccggccucugcgggagaagaugaagccggaaaggaggagacccaagggcagggggaagaggaggagagagaagcagagacccacagacugccaccugugcggcgaugcuguuccccggagguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6316 - RNA, 1515 nt, Artificial Sequence
  mRNA product Design5 comprising derived and/or modified sequence from Homo sapiens__NP_001020537.2__HsVEGFA (wt)
gggagagucccgcagucggcguccagcggcucugcuuguucgugugugugucguugcaggccuuauucaagcuuaccaugacggacagacagacagacaccgcccccagccccagcuaccaccuccuccccggccggcggcggacaguggacgcggcggcgagccgcgggcaggggccggagcccgcgcccggaggcgggguggagggggucggggcucgcggcgucgcacugaaacuuuucguccaacuucugggcuguucucgcuucggaggagccgugguccgcgcgggggaagccgagccgagcggagccgcgagaagugcuagcucgggccgggaggagccgcagccggaggagggggaggaggaagaagagaaggaagaggagagggggccgcaguggcgacucggcgcucggaagccgggcucauggacgggugaggcggcggugugcgcagacagugcuccagccgcgcgcgcuccccaggcccuggcccgggccucgggccggggaggaagaguagcucgccgaggcgccgaggagagcgggccgccccacagcccgagccggagagggagcgcgagccgcgccggccccggucgggccuccgaaaccaugaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaaaaucaguucgaggaaagggaaaggggcaaaaacgaaagcgcaagaaaucccgguauaaguccuggagcguguacguuggugcccgcugcugucuaaugcccuggagccucccuggcccccaucccugugggccuugcucagagcggagaaagcauuuguuuguacaagauccgcagacguguaaauguuccugcaaaaacacagacucgcguugcaaggcgaggcagcuugaguuaaacgaacguacuugcagaugugacaagccgaggcggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6317 - RNA, 975 nt, Artificial Sequence
  mRNA product Design5 comprising derived and/or modified sequence from Homo sapiens__NP_001165094.1__HsVEGFA (wt)
gggagagucccgcagucggcguccagcggcucugcuuguucgugugugugucguugcaggccuuauucaagcuuaccaugaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaaaaucaguucgaggaaagggaaaggggcaaaaacgaaagcgcaagaaaucccgguauaaguccuggagcguguacguuggugcccgcugcugucuaaugcccuggagccucccuggcccccaucccugugggccuugcucagagcggagaaagcauuuguuuguacaagauccgcagacguguaaauguuccugcaaaaacacagacucgcguugcaaggcgaggcagcuugaguuaaacgaacguacuugcagaugugacaagccgaggcggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6318 - RNA, 900 nt, Artificial Sequence
  mRNA product Design5 comprising derived and/or modified sequence from Homo sapiens__NP_003368.1__HsVEGFB (wt)
gggagagucccgcagucggcguccagcggcucugcuuguucgugugugugucguugcaggccuuauucaagcuuaccaugagcccucugcuccgccgccugcugcucgccgcacuccugcagcuggcccccgcccaggccccugucucccagccugaugccccuggccaccagaggaaaguggugucauggauagauguguauacucgcgcuaccugccagccccgggaggugguggugcccuugacuguggagcucaugggcaccguggccaaacagcuggugcccagcugcgugacugugcagcgcugugguggcugcugcccugacgauggccuggagugugugcccacugggcagcaccaaguccggaugcagauccucaugauccgguacccgagcagucagcugggggagaugucccuggaagaacacagccagugugaaugcagaccuaaaaaaaaggacagugcugugaagccagacagggcugccacuccccaccaccguccccagccccguucuguuccgggcugggacucugcccccggagcacccuccccagcugacaucacccaucccacuccagccccaggccccucugcccacgcugcacccagcaccaccagcgcccugacccccggaccugccgcugccgcugccgacgccgcagcuuccuccguugccaagggcggggcuuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6319 - RNA, 1536 nt, Artificial Sequence
  mRNA product Design5 comprising derived and/or modified sequence from Homo sapiens__NP_005420.1__HsVEGFC (wt)
gggagagucccgcagucggcguccagcggcucugcuuguucgugugugugucguugcaggccuuauucaagcuuaccaugcacuugcugggcuucuucucuguggcguguucucugcucgccgcugcgcugcucccggguccucgcgaggcgcccgccgccgccgccgccuucgaguccggacucgaccucucggacgcggagcccgacgcgggcgaggccacggcuuaugcaagcaaagaucuggaggagcaguuacggucuguguccaguguagaugaacucaugacuguacucuacccagaauauuggaaaauguacaagugucagcuaaggaaaggaggcuggcaacauaacagagaacaggccaaccucaacucaaggacagaagagacuauaaaauuugcugcagcacauuauaauacagagaucuugaaaaguauugauaaugaguggagaaagacucaaugcaugccacgggagguguguauagauguggggaaggaguuuggagucgcgacaaacaccuucuuuaaaccuccauguguguccgucuacagauguggggguugcugcaauagugaggggcugcagugcaugaacaccagcacgagcuaccucagcaagacguuauuugaaauuacagugccucucucucaaggccccaaaccaguaacaaucaguuuugccaaucacacuuccugccgaugcaugucuaaacuggauguuuacagacaaguucauuccauuauuagacguucccugccagcaacacuaccacagugucaggcagcgaacaagaccugccccaccaauuacauguggaauaaucacaucugcagaugccuggcucaggaagauuuuauguuuuccucggaugcuggagaugacucaacagauggauuccaugacaucuguggaccaaacaaggagcuggaugaagagaccugucagugugucugcagagcggggcuucggccugccagcuguggaccccacaaagaacuagacagaaacucaugccagugugucuguaaaaacaaacucuuccccagccaauguggggccaaccgagaauuugaugaaaacacaugccaguguguauguaaaagaaccugccccagaaaucaaccccuaaauccuggaaaaugugccugugaauguacagaaaguccacagaaaugcuuguuaaaaggaaagaaguuccaccaccaaacaugcagcuguuacagacggccauguacgaaccgccagaaggcuugugagccaggauuuucauauagugaagaagugugucguugugucccuucauauuggaaaagaccacaaaugagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6320 - RNA, 1341 nt, Artificial Sequence
  mRNA product Design5 comprising derived and/or modified sequence from Homo sapiens__NP_004460.1__HsVEGFD (wt)
gggagagucccgcagucggcguccagcggcucugcuuguucgugugugugucguugcaggccuuauucaagcuuaccauguacagagaguggguaguggugaauguuuucaugauguuguacguccagcuggugcagggcuccaguaaugaacauggaccagugaagcgaucaucucaguccacauuggaacgaucugaacagcagaucagggcugcuucuaguuuggaggaacuacuucgaauuacucacucugaggacuggaagcuguggagaugcaggcugaggcucaaaaguuuuaccaguauggacucucgcucagcaucccaucgguccacuagguuugcggcaacuuucuaugacauugaaacacuaaaaguuauagaugaagaauggcaaagaacucagugcagcccuagagaaacgugcguggagguggccagugagcuggggaagaguaccaacacauucuucaagcccccuugugugaacguguuccgaugugguggcuguugcaaugaagagagccuuaucuguaugaacaccagcaccucguacauuuccaaacagcucuuugagauaucagugccuuugacaucaguaccugaauuagugccuguuaaaguugccaaucauacagguuguaagugcuugccaacagccccccgccauccauacucaauuaucagaagauccauccagaucccugaagaagaucgcuguucccauuccaagaaacucuguccuauugacaugcuaugggauagcaacaaauguaaauguguuuugcaggaggaaaauccacuugcuggaacagaagaccacucucaucuccaggaaccagcucucugugggccacacaugauguuugacgaagaucguugcgagugugucuguaaaacaccaugucccaaagaucuaauccagcaccccaaaaacugcaguugcuuugagugcaaagaaagucuggagaccugcugccagaagcacaagcuauuucacccagacaccugcagcugugaggacagaugccccuuucauaccagaccaugugcaaguggcaaaacagcaugugcaaagcauugccgcuuuccaaaggagaaaagggcugcccaggggccccacagccgaaagaauccuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6321 - RNA, 906 nt, Artificial Sequence
  mRNA product Design5 comprising derived and/or modified sequence from Homo sapiens__NP_061986.1__HsFGF21 (opt1)
gggagagucccgcagucggcguccagcggcucugcuuguucgugugugugucguugcaggccuuauucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcugcugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggcccucccagggccggagccccuccuacgccagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6322 - RNA, 1686 nt, Artificial Sequence
  mRNA product Design5 comprising derived and/or modified sequence from Homo sapiens__NP_002412.1__HsMMP1 (opt1)
gggagagucccgcagucggcguccagcggcucugcuuguucgugugugugucguugcaggccuuauucaagcuuaccaugcacagcuucccgccccugcuccugcugcucuucuggggcguggucucccacagcuuccccgccacccuggagacccaggagcaggacguggaccuggugcagaaguaccucgagaaguacuacaaccugaagaacgacgggcgccaggucgagaagcggcgcaacuccggccccgugguggagaagcugaagcagaugcaggaguucuucgggcucaaggucacgggcaagcccgacgccgagacccugaaggugaugaagcagccgcggugcggggugcccgacgucgcgcaguucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6323 - RNA, 1446 nt, Artificial Sequence
  mRNA product Design5 comprising derived and/or modified sequence from Homo sapiens__NP_002412.1__HsMMP1(1-19,100-469) (opt1) R6148/R6221
gggagagucccgcagucggcguccagcggcucugcuuguucgugugugugucguugcaggccuuauucaagcuuaccaugcacagcuucccgccccugcuccugcugcucuucuggggcguggucucccacagcuucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6324 - RNA, 3633 nt, Artificial Sequence
  mRNA product Design5 comprising derived and/or modified sequence from Clostridium histolyticum__BAA77453.1__ColG (opt1)
gggagagucccgcagucggcguccagcggcucugcuuguucgugugugugucguugcaggccuuauucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6325 - RNA, 3357 nt, Artificial Sequence
  mRNA product Design5 comprising derived and/or modified sequence from Clostridium histolyticum__BAA77453.1__HsALB(1-18)_ColG(111-1118) (opt1) R6149/R6222
gggagagucccgcagucggcguccagcggcucugcuuguucgugugugugucguugcaggccuuauucaagcuuaccaugaagugggugaccuucaucagccugcucuuccuguucuccagcgccuacuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6326 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt1)
gggagagucccgcagucggcguccagcggcucugcuuguucgugugugugucguugcaggccuuauucaagcuuaccaugaagugggugaccuucaucagccugcucuuccuguucuccagcgccuacuccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6327 - RNA, 3381 nt, Artificial Sequence
  mRNA product Design5 comprising derived and/or modified sequence from Clostridium histolyticum__BAA34542.1__ColH (opt1)
gggagagucccgcagucggcguccagcggcucugcuuguucgugugugugucguugcaggccuuauucaagcuuaccaugaacuuccugaagaucauccucaaccgcggcaagaccaugaagcggaagugccugagcaagcgccugaugcucgccaucaccauggccacgaucuucaccgugaacuccacccugcccaucuacgcggccgucgacaagaacaacgccaccgccgccgugcagaacgagagcaagcgguacacgguguccuaccugaagacccucaacuacuacgaccuggucgaccugcucgugaagaccgagaucgagaaccugccggaccuguuccaguacagcuccgacgcgaaggaguucuacgggaacaagacccgcaugagcuucaucauggacgagaucggccggcgcgcgccccaguacacggagaucgaccacaaggggauccccacccucguggaggucgugcgggccggcuucuaccugggguuccacaacaaggagcugaacgagaucaacaagcgcuccuucaaggagcgggugauccccagcauccucgccauccagaagaacccgaacuucaagcugggcaccgagguccaggacaagaucguguccgccaccggccugcucgccgggaacgagacggccccgcccgagguggucaacaacuucacccccauccugcaggacugcaucaagaacaucgaccgcuacgcccuggacgaccucaagagcaaggcccuguucaacgugcuggcggccccgaccuacgacaucaccgaguaccuccgggccacgaaggagaagcccgagaacacccccugguacggcaagaucgacggguucaucaacgagcugaagaagcuggcccucuacggcaagaucaacgacaacaacuccuggaucaucgacaacgggaucuaccacaucgcgccccugggcaagcugcacagcaacaacaagaucggcaucgagacccucaccgaggugaugaaggucuacccguaccuguccaugcagcaccuccagagcgccgaccagaucaagcgccacuacgacuccaaggacgccgaggggaacaagaucccccuggacaaguucaagaaggagggcaaggagaaguacugccccaagacguacaccuucgacgacgggaaggugaucaucaaggccggcgcccggguggaggaggagaaggucaagcgccuguacugggccagcaaggaggugaacucccaguucuuccggguguacggcaucgacaagccccuggaggaggggaacccggacgacauccucaccauggucaucuacaacagccccgaggaguacaagcugaacuccgugcuguacggcuacgacaccaacaacgggggcauguacaucgagcccgaggggacguucuucaccuacgagcgcgaggcgcaggagagcaccuacacccucgaggagcuguuccggcacgaguacacgcacuaccugcagggccgcuacgccgugcccggccagugggggcggaccaagcucuacgacaacgaccgccugaccugguacgaggagggcggggccgagcuguucgccggcagcacccggacguccgggauccucccgcgcaagagcaucgucuccaacauccacaacaccacccgcaacaaccgguacaagcugagcgacaccgugcacuccaaguacggcgccagcuucgaguucuacaacuacgcgugcauguucauggacuacauguacaacaaggacaugggcauccugaacaagcucaacgaccuggccaagaacaacgacgucgacggguacgacaacuacauccgcgaccuguccagcaacuacgcccugaacgacaaguaccaggaccacaugcaggagcggaucgacaacuacgagaaccucacggugcccuucguggccgacgacuaccugguccgccacgcguacaagaaccccaacgagaucuacuccgagaucagcgagguggccaagcugaaggacgccaaguccgaggugaagaagucccaguacuucagcaccuucacccuccggggcagcuacaccgggggcgccuccaaggggaagcuggaggaccagaaggccaugaacaaguucaucgacgacagccugaagaagcucgacaccuacuccuggagcggcuacaagacgcugaccgcguacuucaccaacuacaaggucgacuccagcaaccgcgugaccuacgacguggucuuccacggcuaccugcccaacgagggggacagcaagaacucccucccguacggcaagaucaacgggacguacaagggcaccgagaaggagaagaucaaguucagcuccgagggcagcuucgaccccgacgggaagaucguguccuacgagugggacuucggcgacgggaacaagagcaacgaggagaaccccgagcacuccuacgacaaggugggcaccuacaccgucaagcugaaggugacggacgacaagggggagagcuccgugagcaccaccaccgccgagaucaaggaccuguccgagaacaagcuccccgucaucuacaugcacgugcccaagagcggcgcccugaaccagaagguggucuucuacggcaaggggacguacgaccccgacggcuccaucgccggguaccagugggacuucggcgacgggagcgacuucuccagcgagcagaaccccucccacguguacaccaagaagggcgaguacaccgugacccugcgggucauggacagcagcggccagauguccgagaagacgaugaagaucaagaucaccgacccgguguaccccaucgggaccgagaaggagcccaacaacagcaaggagaccgccuccggccccaucgugccggggauccccgucagcggcacgaucgagaacaccuccgaccaggacuacuucuacuucgacgugaucacccccggggaggugaagaucgacaucaacaagcucggcuacggcggggcgaccugggucguguacgacgagaacaacaacgccgugagcuacgccacggacgacggccagaaccuguccgggaaguucaaggccgacaagcccggccgcuacuacauccaccuguacauguucaacgggagcuacaugccguaccggaucaacaucgagggcuccgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6328 - RNA, 3342 nt, Artificial Sequence
  mRNA product Design5 comprising derived and/or modified sequence from Clostridium histolyticum__BAA34542.1__ColH (opt1)
gggagagucccgcagucggcguccagcggcucugcuuguucgugugugugucguugcaggccuuauucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6329 - RNA, 3276 nt, Artificial Sequence
  mRNA product Design5 comprising derived and/or modified sequence from Clostridium histolyticum__BAA34542.1__HsALB(1-18)_ColH(41-1021) (opt1) R6150/R6223
gggagagucccgcagucggcguccagcggcucugcuuguucgugugugugucguugcaggccuuauucaagcuuaccaugaagugggugaccuucaucagccugcucuuccuguucuccagcgccuacuccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6330 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt1)
gggagagucccgcagucggcguccagcggcucugcuuguucgugugugugucguugcaggccuuauucaagcuuaccaugaagugggugaccuucaucagccugcucuuccuguucuccagcgccuacuccaugaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6331 - RNA, 852 nt, Artificial Sequence
  mRNA product Design5 comprising derived and/or modified sequence from Homo sapiens__NP_001133.1__HsAMELX (opt1)
gggagagucccgcagucggcguccagcggcucugcuuguucgugugugugucguugcaggccuuauucaagcuuaccaugggcaccuggauccuguucgccugccuccugggggccgcguucgccaugccccugccgccccaccccggccaccccggguacaucaacuucagcuacgaggugcucaccccgcugaagugguaccaguccauccgcccgcccuaccccagcuacggcuacgagcccaugggcggguggcugcaccaccagaucauccccguccucucccagcagcacccgcccacgcacacccugcagccgcaccaccacauccccguggugcccgcccagcagcccgucaucccccagcagcccaugaugcccgugcccggccagcacagcaugaccccgauccagcaccaccagcccaaccugcccccgccggcccagcagcccuaccagccccagcccgugcagccccagccccaccagcccaugcagccgcagccgcccguccaccccaugcagccgcucccgccccagcccccgcugccgcccauguuccccaugcagccccugccgcccaugcuccccgaccugacccuggaggccuggcccuccacggacaagaccaagcgggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6332 - RNA, 411 nt, Artificial Sequence
  mRNA product Design5 comprising derived and/or modified sequence from Homo sapiens__NP_001133.1__HsAMELX-TRAP (opt1)
gggagagucccgcagucggcguccagcggcucugcuuguucgugugugugucguugcaggccuuauucaagcuuaccaugccccugccgccccaccccggccaccccggguacaucaacuucagcuacgaggugcucaccccgcugaagugguaccaguccauccgcccgcccuaccccagcuacggcuacgagcccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6333 - RNA, 444 nt, Artificial Sequence
  mRNA product Design5 comprising derived and/or modified sequence from Homo sapiens__NP_001133.1__HsAMELX-LRAP (opt1)
gggagagucccgcagucggcguccagcggcucugcuuguucgugugugugucguugcaggccuuauucaagcuuaccaugccccugccgccccaccccggccaccccggguacaucaacuucagcuacgaggugcucaccccgcugaagugguaccaguccauccgcccgccgcccaugcuccccgaccugacccuggaggccuggcccuccacggacaagaccaagcgggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6334 - RNA, 483 nt, Artificial Sequence
  mRNA product Design5 comprising derived and/or modified sequence from Homo sapiens__NP_001133.1__HLA-A2-SP_HsAMELX(17-60) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgcccuaccccagcuacggcuacgagcccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6335 - RNA, 516 nt, Artificial Sequence
  mRNA product Design5 comprising derived and/or modified sequence from Homo sapiens__NP_001133.1__HLA-A2-SP_HsAMELX(17-47,168-191) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgccgcccaugcuccccgaccugacccuggaggccuggcccuccacggacaagaccaagcgggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6336 - RNA, 855 nt, Artificial Sequence
  mRNA product Design5 comprising derived and/or modified sequence from Homo sapiens__NP_001134.1__HsAMELY (opt1)
gggagagucccgcagucggcguccagcggcucugcuuguucgugugugugucguugcaggccuuauucaagcuuaccaugggcaccuggauccuguucgccugccucgugggggccgcguucgccaugccccugccgccccaccccggccaccccggguacaucaacuucagcuacgagguccugaccccgcucaagugguaccaguccaugauccgcccgcccuacagcuccuacggcuacgagcccaugggcggguggcugcaccaccagaucauccccguggugagccagcagcacccccugacgcacacccuccagucccaccaccacauccccgucgugcccgcccagcagccgcgggugcgccagcaggcccugaugcccguccccggccagcagagcaugacccccacccagcaccaccagccgaaccugccccuccccgcccagcagcccuuccagccgcagcccgugcagccccagccccaccagccgaugcagccccagccgcccgugcagcccaugcagccccugcugccccagccgccccucccgcccauguucccccugcggccccugccgcccauccuccccgaccugcaccuggaggcguggcccgccacggacaagaccaagcaggaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6337 - RNA, 414 nt, Artificial Sequence
  mRNA product Design5 comprising derived and/or modified sequence from Homo sapiens__NP_001134.1__HsAMELY-TRAP (opt1)
gggagagucccgcagucggcguccagcggcucugcuuguucgugugugugucguugcaggccuuauucaagcuuaccaugccccugccgccccaccccggccaccccggguacaucaacuucagcuacgagguccugaccccgcucaagugguaccaguccaugauccgcccgcccuacagcuccuacggcuacgagcccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6338 - RNA, 447 nt, Artificial Sequence
  mRNA product Design5 comprising derived and/or modified sequence from Homo sapiens__NP_001134.1__HsAMELY-LRAP (opt1)
gggagagucccgcagucggcguccagcggcucugcuuguucgugugugugucguugcaggccuuauucaagcuuaccaugccccugccgccccaccccggccaccccggguacaucaacuucagcuacgagguccugaccccgcucaagugguaccaguccaugauccgcccgccgcccauccuccccgaccugcaccuggaggcguggcccgccacggacaagaccaagcaggaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6339 - RNA, 486 nt, Artificial Sequence
  mRNA product Design5 comprising derived and/or modified sequence from Homo sapiens__NP_001134.1__HLA-A2-SP_HsAMELY(17-61) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucagcuacgagguccugaccccgcucaagugguaccaguccaugauccgcccgcccuacagcuccuacggcuacgagcccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6340 - RNA, 519 nt, Artificial Sequence
  mRNA product Design5 comprising derived and/or modified sequence from Homo sapiens__NP_001134.1__HLA-A2-SP_HsAMELY(17-48,169-192) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucagcuacgagguccugaccccgcucaagugguaccaguccaugauccgcccgccgcccauccuccccgaccugcaccuggaggcguggcccgccacggacaagaccaagcaggaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6341 - RNA, 846 nt, Artificial Sequence
  mRNA product Design5 comprising derived and/or modified sequence from Sus scrofa__NP_999071.1__SsAMELX-001-1 (opt1)
gggagagucccgcagucggcguccagcggcucugcuuguucgugugugugucguugcaggccuuauucaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccuacacgagcuacggcuacgagcccaugggcggguggcugcaccaccagaucauccccgucgugucccagcagaccccgcagagccacgcccuccagccccaccaccacauccccauggugcccgcccagcagccgggcaucccccagcagcccaugaugccccugccggggcagcacuccaugacccccacccagcaccaccagcccaaccugccccucccggcccagcagcccuuccagccccagcccguccagccgcagccccaccagccccugcagccccagagcccgaugcaccccauccagccccugcucccgcagccgccccugcccccgauguucuccaugcagagccugcuccccgaccugccccuggaggccuggcccgcgacggacaagaccaagcgggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6342 - RNA, 414 nt, Artificial Sequence
  mRNA product Design5 comprising derived and/or modified sequence from Sus scrofa__NP_999071.1__SsAMELX-TRAP (opt1)
gggagagucccgcagucggcguccagcggcucugcuuguucgugugugugucguugcaggccuuauucaagcuuaccaugccccugccgccccaccccggccaccccggguacaucaacuucuccuacgaggugcucaccccgcugaagugguaccagaacaugauccgccaccccuacacgagcuacggcuacgagcccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6343 - RNA, 447 nt, Artificial Sequence
  mRNA product Design5 comprising derived and/or modified sequence from Sus scrofa__NP_999071.1__SsAMELX-LRAP (opt1)
gggagagucccgcagucggcguccagcggcucugcuuguucgugugugugucguugcaggccuuauucaagcuuaccaugccccugccgccccaccccggccaccccggguacaucaacuucuccuacgaggugcucaccccgcugaagugguaccagaacaugauccgccaccccagccugcuccccgaccugccccuggaggccuggcccgcgacggacaagaccaagcgggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6344 - RNA, 486 nt, Artificial Sequence
  mRNA product Design5 comprising derived and/or modified sequence from Sus scrofa__NP_999071.1__HLA-A2-SP_SsAMEL(17-61) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccuacacgagcuacggcuacgagcccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6345 - RNA, 519 nt, Artificial Sequence
  mRNA product Design5 comprising derived and/or modified sequence from Sus scrofa__NP_999071.1__HLA-A2-SP_SsAMEL(17-49,167-189) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccagccugcuccccgaccugccccuggaggccuggcccgcgacggacaagaccaagcgggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6346 - RNA, 810 nt, Artificial Sequence
  mRNA product Design5 comprising derived and/or modified sequence from Sus scrofa__P45561-2__SsAMELX-001-2 (opt1)
gggagagucccgcagucggcguccagcggcucugcuuguucgugugugugucguugcaggccuuauucaagcuuaccaugggcaccuggauccuguucgccugccuccugggggccgcguucagcaugccccugccgccccaccccggccaccccggguacaucaacuucuccuacauccgccacccguacaccagcuacggcuacgagcccaugggcggguggcuccaccaccagaucauccccguggucucccagcagacgccccagagccacgcccugcagccgcaccaccacauccccauggugcccgcccagcagcccggcaucccgcagcagcccaugaugccccugcccgggcagcacuccaugaccccgacccagcaccaccagcccaaccucccccugcccgcccagcagccguuccagccccagcccgugcagccccagccgcaccagccccugcagccccagagccccaugcacccgauccagccccuccugccccagccgccccugccgcccauguucuccaugcagagccuccugcccgaccugccccucgaggccuggcccgcgaccgacaagacgaagcgggaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6347 - RNA, 846 nt, Artificial Sequence
  mRNA product Design5 comprising derived and/or modified sequence from Sus scrofa__NP_998965.1__SsAMELX-001-3 (opt1)
gggagagucccgcagucggcguccagcggcucugcuuguucgugugugugucguugcaggccuuauucaagcuuaccaugggcaccuggaucuucuucgccugccugcucggggccagccuggcgaugccccugccgccccaccccggccaccccggguacaucaacuucuccuacgaggugcucacgccccugaagugguaccagaacaugauccgccaccccuacaccagcuacggcuacgagcccaugggcggguggcugcaccaccagaucauccccgucgugucccagcagaccccgcagagccacgcccuccagccccaccaccacauccccauggugcccgcccagcagccgggcaucccccagcagcccaugaugccccugccggggcagcacuccaugacccccacccagcaccaccagcccaaccugccccucccggcccagcagcccuuccagccccagcccguccagccgcagccccaccagccccugcagccccagagcccgaugcaccccauccagccccugcucccgcagccgccccugccgcccauguucuccaugcagagccugcuccccgaccugccccuggaggccuggcccgcgacggacaagaccaagcgggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6348 - RNA, 495 nt, Artificial Sequence
  mRNA product Design5 comprising derived and/or modified sequence from Sus scrofa__K7GPB2__SsAMELX-002 (opt1)
gggagagucccgcagucggcguccagcggcucugcuuguucgugugugugucguugcaggccuuauucaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccagccugcuccccgaccugccccuggaggccuggccggccacggacaagaccaagcgggaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6349 - RNA, 888 nt, Artificial Sequence
  mRNA product Design5 comprising derived and/or modified sequence from Sus scrofa__K7GLD0__SsAMELX-003 (opt1)
gggagagucccgcagucggcguccagcggcucugcuuguucgugugugugucguugcaggccuuauucaagcuuaccaugggcaccuggauccuguucgccugccuccugggggccgcguucagcaugccccugccgccccaccccggccaccccggguacaucaacuucuccuacgaggaccucuaccuggaggccauccgcaucgaccggaccgccuucgugcugacgccccucaagugguaccagaacaugauccgccaccccuacaccagcuacggcuacgagcccaugggcggguggcugcaccaccagaucauccccgucgugucccagcagaccccgcagagccacgcccugcagccccaccaccacauccccauggugcccgcccagcagccgggcaucccccagcagcccaugaugccccucccggggcagcacuccaugacccccacgcagcaccaccagcccaaccugccccugccggcgcagcagcccuuccagccccagcccguccagccgcagccccaccagccccuccagccccagagcccgaugcaccccauccagccccugcugccgcagccgccccugccgcccauguucuccaugcagagccuccugcccgaccucccccuggaggccuggcccgccaccgacaagaccaagcgggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6350 - RNA, 774 nt, Artificial Sequence
  mRNA product Design5 comprising derived and/or modified sequence from Sus scrofa__K7GPE9__SsAMELX-004 (opt1)
gggagagucccgcagucggcguccagcggcucugcuuguucgugugugugucguugcaggccuuauucaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccacgccccagagccacgcccugcagccccaccaccacaucccgaugguccccgcccagcagcccggcaucccccagcagccgaugaugccccuccccgggcagcacuccaugacccccacccagcaccaccagccgaaccugccccugcccgcccagcagcccuuccagccgcagcccgugcagccccagccccaccagccgcuccagccccagagccccaugcaccccauccagccgcugcugccccagcccccgcucccgcccauguucuccaugcagagccugcugcccgaccucccccuggaggccuggcccgcgaccgacaagacgaagcgggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6351 - RNA, 798 nt, Artificial Sequence
  mRNA product Design5 comprising derived and/or modified sequence from Sus scrofa__J9JIM4__SsAMELX-201 (opt1)
gggagagucccgcagucggcguccagcggcucugcuuguucgugugugugucguugcaggccuuauucaagcuuaccaugccccugccgccccaccccggccaccccggguacaucaacuucagcuacgaggugcucaccccgcugaagugguaccagaacaugauccgccaccccuacaccuccuacggcuacgagcccaugggcggguggcugcaccaccagaucauccccgucgugagccagcagacgccgcagucccacgcccuccagccccaccaccacauccccauggugcccgcccagcagcccgggaucccccagcagcccaugaugccccugccgggccagcacagcaugacccccacccagcaccaccagcccaaccugccccucccggcgcagcagcccuuccagccccagcccguccagccgcagccccaccagccccugcagccccaguccccgaugcaccccauccagccccugcucccgcagccgccccugccgcccauguucagcaugcagucccugcuccccgaccugccccuggaggccuggcccgccaccgacaagacgaagcgggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6352 - RNA, 3237 nt, Artificial Sequence
  mRNA product Design5 comprising derived and/or modified sequence from Homo sapiens__NP_006120.1__HsBMP1 (opt1)
gggagagucccgcagucggcguccagcggcucugcuuguucgugugugugucguugcaggccuuauucaagcuuaccaugcccggcguggcccgccugccgcuccugcuggggcuccugcugcucccccggcccggccgcccccuggaccuggccgacuacaccuacgaccucgccgaggaggacgacagcgagccgcugaacuacaaggaccccugcaaggccgccgccuuccugggggacaucgcccucgacgaggaggaccugcgggcguuccagguccagcaggccguggaccugcgccggcacaccgcccgcaaguccagcaucaaggccgcggugcccggcaacacguccacccccagcugccaguccaccaacgggcagccgcagcggggcgccugcggccgcuggcgggggcgcagccggucccgccgggccgccaccagccgccccgagcgggucuggcccgacggcgugauccccuucgugaucgggggcaacuucacggggucccagcgcgccgucuuccggcaggcgaugcgccacugggagaagcacacgugcgugaccuuccucgagcggaccgacgaggacagcuacaucguguucaccuaccgcccgugcggcugcugcuccuacgucggccggcgcgggggcgggccccaggccaucagcaucggcaagaacugcgacaaguucggcaucguggugcacgagcuggggcacgucgugggcuucuggcacgagcacacccgccccgaccgggaccgccacguguccaucguccgggagaacauccagcccgggcaggaguacaacuuccugaagauggagccgcaggagguggagagccucggcgagaccuacgacuucgacuccaucaugcacuacgcccgcaacaccuucagccgggggaucuuccuggacacgaucgugcccaaguacgaggucaacggcgugaagccgcccaucggccagcgcacccggcuguccaagggggacaucgcccaggcccgcaagcucuacaagugccccgcgugcggcgagacccugcaggacagcaccgggaacuucuccagccccgaguaccccaacggcuacagcgcccacaugcacugcguguggcggaucuccgucacgcccggggagaagaucauccugaacuucaccagccucgaccuguaccgcucccggcugugcugguacgacuacguggaggugcgcgacggcuucuggcggaaggccccgcuccgcggccgguucugcgggagcaagcugcccgagcccaucgucuccaccgacagccgccuguggguggaguuccgguccagcuccaacugggucggcaagggguucuucgccguguacgaggccaucugcggcggggacgugaagaaggacuacggccacauccagagccccaacuacccggacgacuaccgccccuccaaggucugcaucuggcggauccaggugagcgagggcuuccacguggggcucaccuuccaguccuucgagaucgagcgccacgacagcugcgcguacgacuaccuggagguccgcgacggccacuccgagagcuccacgcugaucgggcgguacugcggcuacgagaagcccgacgacaucaagagcaccuccagccgccucuggcugaaguucgugagcgacggcuccaucaacaaggccggguucgccgugaacuucuucaaggaggucgacgagugcagccggccgaaccgcggcgggugcgagcagcggugccugaacacccucggcuccuacaagugcagcugcgaccccggguacgagcuggcccccgacaagcgccggugcgaggccgcgugcggcggcuuccugaccaagcucaacggguccaucacgagccccggcuggccgaaggaguacccgcccaacaagaacugcaucuggcagcugguggcccccacccaguaccgcaucucccugcaguucgacuucuucgagaccgaggggaacgacgugugcaaguacgacuucgucgaggugcggagcggccucaccgccgacuccaagcugcacgggaaguucugcggcagcgagaagcccgaggugaucacgucccaguacaacaacaugcgcgucgaguucaagagcgacaacaccguguccaagaagggcuucaaggcccacuucuucagcgacaaggacgagugcuccaaggacaacgggggcugccagcaggacugcgugaacaccuucgggagcuacgagugccagugccgguccggcuucguccugcacgacaacaagcacgacugcaaggaggcggggugcgaccacaaggugaccagcacgagcggcaccaucaccucccccaacuggcccgacaaguaccccagcaagaaggagugcaccugggccaucuccagcacgccgggccaccgcgugaagcucaccuucauggagauggacaucgagucccagcccgagugcgccuacgaccaccuggaggucuucgacgggcgggacgccaaggcccccgugcugggccgcuucugcgggagcaagaagcccgagccggugcucgcgaccggcucccggauguuccugcgcuucuacagcgacaacuccguccagcggaagggguuccaggccagccacgccaccgagugcggcggccaggugcgcgccgacgugaagaccaaggaccuguacucccacgcccaguucggggacaacaacuaccccggcggggucgacugcgagugggugaucguggcggaggagggcuacggcgucgagcugguguuccagacguucgagguggaggaggagaccgacugcggguacgacuacauggagcuguucgacggcuacgacagcaccgcgccccggcucgggcgcuacugcggcuccgggcccccggaggaggucuacagcgccggcgacuccgugcuggugaaguuccacagcgacgacaccaucacgaagaagggcuuccaccuccgguacaccuccaccaaguuccaggacacccugcacagccgcaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6353 - RNA, 1467 nt, Artificial Sequence
  mRNA product Design5 comprising derived and/or modified sequence from Homo sapiens__NP_001191.1__HsBMP2 (opt1)
gggagagucccgcagucggcguccagcggcucugcuuguucgugugugugucguugcaggccuuauucaagcuuaccaugguggccggcacccgcugccugcucgcccugcugcucccccagguccugcucgggggcgcggccgggcuggugccggagcugggccggcgcaaguucgccgccgccagcuccgggcggcccagcucccagcccagcgacgaggugcuguccgaguucgagcuccgccugcugagcauguucggccucaagcagcggcccaccccgucccgcgacgcggucgugccgcccuacaugcuggaccuguaccggcgccacagcggccagcccgggucccccgcccccgaccaccggcucgagcgcgccgccagccgggcgaacacggugcgcuccuuccaccacgaggagagccuggaggagcugcccgagaccuccggcaagaccacccggcgcuucuucuucaaccucagcuccauccccacggaggaguucaucaccagcgccgagcugcaggucuuccgggagcagaugcaggacgcccuggggaacaacuccagcuuccaccaccgcaucaacaucuacgagaucaucaagccggccaccgccaacuccaaguuccccgugacccggcuccuggacacgcgccuggugaaccagaacgcgagccggugggagagcuucgacgucacccccgccgugaugcgcuggaccgcccagggccacgccaaccacggguucguggucgagguggcccaccucgaggagaagcagggcguguccaagcggcacguccgcaucagccgcucccugcaccaggacgagcacagcuggucccagauccggccccugcucgugaccuucggccacgacgggaagggccacccgcugcacaagcgcgagaagcggcaggcgaagcacaagcagcgcaagcggcucaagagcuccugcaagcgccacccccuguacguggacuucagcgacgucggguggaacgacuggaucguggccccgcccggcuaccacgccuucuacugccacggcgagugccccuucccccuggccgaccaccugaacuccacgaaccacgccaucgugcagacccucgucaacagcgugaacuccaagauccccaaggcgugcugcgugcccaccgagcugagcgccaucuccaugcuguaccucgacgagaacgagaaggucgugcugaagaacuaccaggacauggucguggaggggugcggcugccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6354 - RNA, 1503 nt, Artificial Sequence
  mRNA product Design5 comprising derived and/or modified sequence from Homo sapiens__NP_001193.2__HsBMP4 (opt1)
gggagagucccgcagucggcguccagcggcucugcuuguucgugugugugucguugcaggccuuauucaagcuuaccaugauccccggcaaccgcaugcugauggugguccuccugugccaggugcugcucgggggcgccagccacgccucccugaucccggagaccgggaagaagaagguggcggagauccagggccacgccgggggccggcgcagcggccagucccacgagcugcuccgggacuucgaggccacccugcugcagauguucgggcuccgccggcgcccccagcccagcaaguccgccgucauccccgacuacaugcgggaccuguaccgccugcagagcggcgaggaggaggaggagcagauccacuccacggggcucgaguacccggagcggcccgccagccgcgcgaacaccgugcgguccuuccaccacgaggagcaccuggagaacauccccggcaccagcgagaacuccgccuuccgcuuccuguucaaccucagcuccauccccgagaacgaggugaucagcuccgccgagcugcggcuguuccgcgagcaggucgaccaggggccggacugggagcggggcuuccaccgcaucaacaucuacgaggugaugaagccgcccgccgaggugguccccggccaccucaucacccggcugcuggacacgcgccucgugcaccacaacgugacccggugggagaccuucgacgucagccccgcggugcugcgcuggacccgggagaagcagcccaacuacgggcuggccaucgaggugacgcaccuccaccagacccgcacccaccagggccagcacguccgcaucucccggagccugccccagggguccggcaacugggcccagcugcgcccccuccuggugaccuucggccacgacgggcggggccacgcccugacgcgccggcgccgggccaagcgcagcccgaagcaccacagccagcgggcgcgcaagaagaacaagaacugccggcgccacucccucuacguggacuucagcgacgucggguggaacgacuggaucguggccccgcccggcuaccaggccuucuacugccacggggacugccccuucccccuggccgaccaccugaacuccaccaaccacgccaucgugcagacccucgucaacagcgugaacuccagcauccccaaggcgugcugcgugcccaccgagcuguccgccaucagcaugcuguaccucgacgaguacgacaaggucgugcugaagaacuaccaggagauggucguggagggcugcggcugccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6355 - RNA, 1818 nt, Artificial Sequence
  mRNA product Design5 comprising derived and/or modified sequence from Homo sapiens__NP_001709.1__HsBMP6 (opt1)
gggagagucccgcagucggcguccagcggcucugcuuguucgugugugugucguugcaggccuuauucaagcuuaccaugcccggccuggggcgccgggcccaguggcucugcuggugguggggccugcugugcagcugcugcgggccgccgccccuccggccgccccugcccgccgcggccgccgccgccgcgggcgggcagcugcucggcgacggcgggucccccggccggaccgagcagcccccgcccagcccccaguccagcuccggguuccuguaccgccggcugaagacccaggagaagcgcgagaugcagaaggagauccucagcgugcugggccugccccaccggccccgcccccuccacgggcugcagcagccccagcccccggcccugcggcagcaggaggagcagcagcagcagcagcagcucccccgcggcgagcccccgcccggccggcugaaguccgcgccccuguucaugcucgaccuguacaacgcccugagcgccgacaacgacgaggacggggccuccgagggcgagcgccagcagagcuggccccacgaggccgccuccagcucccagcggcgccagcccccgcccggggccgcgcacccccucaaccgcaagagccugcuggcccccggcuccggcagcgggggcgccuccccgcucacgagcgcccaggacuccgccuuccugaacgacgcggacauggucaugagcuucgugaaccugguggaguacgacaaggaguucagcccccgccagcggcaccacaaggaguucaaguucaaccucucccagauccccgagggggaggucgugaccgccgccgaguuccgcaucuacaaggacugcgugaugggcagcuucaagaaccagaccuuccugaucuccaucuaccagguccugcaggagcaccagcaccgggacagcgaccucuuccugcuggacacccgcguggugugggccuccgaggagggguggcucgaguucgacaucacggccaccagcaaccugugggucgugaccccgcagcacaacaugggccugcagcucuccguggucacccgggacggcgugcacgugcacccccgcgcggccgggcuggucggccgcgacgggcccuacgacaagcagcccuucaugguggccuucuucaaggugagcgagguccacgugcggacgacccgcuccgccagcucccggcgccggcagcagagccgcaaccgguccacccagagccaggacguggcccgcgucuccagcgcguccgacuacaacagcuccgagcugaagaccgccugccggaagcacgagcucuacgugagcuuccaggaccugggcuggcaggacuggaucaucgccccgaagggguacgccgcgaacuacugcgacggcgagugcagcuucccccugaacgcccacaugaacgccacgaaccacgccaucgugcagacccucguccaccugaugaaccccgaguacgugcccaagccgugcugcgcccccaccaagcugaacgcgaucuccguccucuacuucgacgacaacagcaacgugauccugaagaaguaccgcaacauggugguccgggccugcggcugccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6356 - RNA, 1572 nt, Artificial Sequence
  mRNA product Design5 comprising derived and/or modified sequence from Homo sapiens__NP_001710.1__HsBMP7 (opt1)
gggagagucccgcagucggcguccagcggcucugcuuguucgugugugugucguugcaggccuuauucaagcuuaccaugcacgugcgcagccugcgggccgccgcgccccacuccuucgucgcccucugggccccgcuguuccugcuccgcagcgcccuggccgacuucucccuggacaacgaggugcacagcuccuucauccaccggcgccuccggagccaggagcgccgggagaugcagcgcgagauccuguccauccugggccucccccaccggccccgcccccaccuccaggggaagcacaacagcgcgccgauguucaugcuggaccuguacaacgccauggccguggaggagggcgggggccccgggggccagggcuucuccuaccccuacaaggccgucuucagcacccaggggcccccgcuggcgucccugcaggacagccacuuccucaccgacgccgacauggugauguccuucgugaaccuggucgagcacgacaaggaguucuuccacccccgguaccaccaccgcgaguuccgguucgaccugagcaagauccccgagggcgaggccgugacggccgccgaguuccgcaucuacaaggacuacauccgggagcgcuucgacaacgagaccuuccggaucuccguguaccagguccuccaggagcaccuggggcgcgagagcgaccuguuccuccuggacucccggacccugugggcgagcgaggagggcuggcucguguucgacaucaccgccacguccaaccacuggguggucaacccccgccacaaccuggggcugcagcucagcguggagacccuggacggccagagcaucaacccgaagcuggccggccucaucgggcggcacggcccccagaacaagcagcccuucaugguggccuucuucaaggccaccgagguccacuuccgcuccauccgcagcaccggguccaagcagcggagccagaaccgcuccaagacgcccaagaaccaggaggcgcugcggauggccaacguggccgagaacagcuccagcgaccagcgccaggccugcaagaagcacgagcuguacguguccuuccgggaccucggcuggcaggacuggaucaucgccccggagggcuacgcggccuacuacugcgagggggagugcgccuucccccugaacagcuacaugaacgccaccaaccacgccaucguccagacccuggugcacuucaucaaccccgagaccgugcccaagccgugcugcgcgcccacgcagcucaacgccaucuccguccuguacuucgacgacagcuccaacgugauccugaagaaguaccgcaacauggugguccgggccugcggcugccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6357 - RNA, 576 nt, Artificial Sequence
  mRNA product Design5 comprising derived and/or modified sequence from Homo sapiens__NP_006264.2__HsCCL7 (opt1)
gggagagucccgcagucggcguccagcggcucugcuuguucgugugugugucguugcaggccuuauucaagcuuaccaugaaggccagcgccgcgcugcucugccugcugcucaccgccgccgccuucagcccccagggccuggcccagccgguggggaucaacaccuccacgaccugcugcuaccgcuucaucaacaagaagauccccaagcagcggcuggaguccuaccgccggaccaccagcucccacugcccccgcgaggcggucaucuucaagacgaagcucgacaaggagaucugcgccgaccccacccagaagugggugcaggacuucaugaagcaccuggacaagaagacccagaccccgaagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6358 - RNA, 3900 nt, Artificial Sequence
  mRNA product Design5 comprising derived and/or modified sequence from Homo sapiens__NP_001954.2__HsEGF (opt1)
gggagagucccgcagucggcguccagcggcucugcuuguucgugugugugucguugcaggccuuauucaagcuuaccaugcugcucacccugaucauccugcuccccguggucagcaaguucuccuucgugagccuguccgcgccccagcacuggagcugccccgagggcacccuggccgggaacggcaacuccacgugcguggggcccgcccccuuccucaucuucagccacggcaacuccaucuuccgcaucgacaccgaggggaccaacuacgagcagcuggucguggacgccggcgugagcgucaucauggacuuccacuacaacgagaagcggaucuacuggguggaccuggagcgccagcuccugcagcggguguuccugaacggcucccgccaggagcgggucugcaacaucgagaagaacgugagcgggauggccaucaacuggaucaacgaggaggugaucugguccaaccagcaggagggcaucaucaccgucacggacaugaaggggaacaacagccacauccuccuguccgcccugaaguacccggccaacguggcgguggaccccgucgagcgcuucaucuucuggagcuccgagguggccggcagccucuaccgggccgaccuggacggggugggcgucaaggcccugcucgagaccuccgagaagaucaccgcggugagccuggacgugcuggacaagcgccucuucuggauccaguacaaccgggagggcuccaacagccugaucugcagcugcgacuacgacgggggcuccguccacaucagcaagcaccccacccagcacaaccuguucgccaugucccucuucggggaccgcaucuucuacagcacguggaagaugaagaccaucuggaucgccaacaagcacaccggcaaggacauggugcggaucaaccugcacuccagcuucgugccccugggcgagcucaaggucgugcacccgcuggcccagcccaaggccgaggacgacaccugggagcccgagcagaagcugugcaagcuccgcaaggggaacugcuccagcacggucugcggccaggaccugcagucccaccugugcaugugcgcggagggguacgcccucagccgggaccgcaaguacugcgaggacgugaacgagugcgccuucuggaaccacggcugcacccuggggugcaagaacacccccggcuccuacuacugcacgugcccggugggcuucguccugcuccccgacgggaagcggugccaccagcuggugagcugcccccgcaacguguccgagugcagccacgacugcguccugaccuccgagggcccccucugcuucugcccggaggggagcgugcuggagcgggacggcaagaccugcuccgggugcagcucccccgacaacggcggcugcagccagcugugcgugccccucagccccgucuccugggagugcgacugcuucccgggguacgaccugcagcuggacgagaaguccugcgccgccagcggcccccagcccuuccuccuguucgcgaacagccaggacauccgccacaugcacuucgacgggaccgacuacggcacccugcucucccagcagauggggaugguguacgcccuggaccacgaccccguggagaacaagaucuacuucgcccacacggcccugaaguggaucgagcgggccaacauggacggcagccagcgcgagcggcugaucgaggagggcgucgacgugccggaggggcucgcgguggacuggaucggccgccgcuucuacuggaccgaccgggggaagucccugaucggccgcagcgaccugaacggcaagcgguccaagaucaucaccaaggagaacaucagccagccccgcgggaucgccguccaccccauggccaagcgccucuucuggaccgacacgggcaucaacccccggaucgaguccagcucccugcaggggcugggccggcucgugaucgccagcuccgaccugaucuggccgagcgggaucaccaucgacuuccugaccgacaagcucuacuggugcgacgccaagcaguccgugaucgagauggcgaaccuggacggcagcaagcgccggcgccugacccagaacgacgucggccaccccuucgccguggccguguucgaggacuacgucugguucagcgacugggccaugcccuccgugaugcgggugaacaagcgcacggggaaggaccggguccgccuccagggcagcaugcugaagccguccagccugguggugguccacccccucgcgaagcccggggccgaccccugccuguaccagaacggcgggugcgagcacaucugcaagaagcggcugggcaccgccuggugcuccugccgcgagggcuucaugaaggccagcgacgggaagaccugccucgcccuggacggccaccagcugcucgccgggggcgagguggaccugaagaaccaggugaccccgcuggacauccucuccaagacgcgggucagcgaggacaacaucaccgagucccagcacaugcugguggccgagaucauggugagcgaccaggacgacugcgcccccgucgggugcuccauguacgcccgcugcaucagcgagggcgaggacgcgaccugccagugccugaagggcuucgcgggggacggcaagcucugcuccgacaucgacgagugcgagaugggggugcccgugugcccgccggccagcuccaagugcaucaacaccgagggcggguacgucugccggugcagcgagggcuaccagggcgacgggauccacugccuggacaucgacgagugccagcugggcgagcacuccugcggggagaacgccagcugcacgaacaccgagggcggcuacacgugcaugugcgccgggcgccucuccgagcccggccugaucugccccgacagcacgcccccgccccaccuccgcgaggacgaccaccacuacagcgugcggaacuccgacagcgagugcccccugucccacgacggguacugccugcacgacggcgugugcauguacaucgaggcccuggacaaguacgcgugcaacugcgucgugggguacaucggcgagcgcugccaguaccgggaccucaaguggugggagcugcgccacgccggccacgggcagcagcagaaggugaucgucguggccgugugcgucguggugcuggucaugcuccugcugcucagccuguggggcgcccacuacuaccggacccagaagcugcucuccaagaaccccaagaacccguacgaggagagcucccgcgacgugcggagccgccggcccgcggacaccgaggacgggauguccagcugcccccagcccugguucguggucaucaaggagcaccaggaccugaagaacggcgggcagccgguggccggcgaggacggccaggccgccgacggguccaugcagcccaccagcuggcgccaggagccccagcugugcggcauggggaccgagcagggcugcuggauccccgucuccagcgacaagggguccugcccccaggugauggagcggagcuuccacaugcccuccuacggcacccagacccucgagggcgggguggagaagccccacagccugcuguccgccaacccgcucuggcagcagcgcgcgcuggacccgccccaccagauggagcugacccagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6359 - RNA, 786 nt, Artificial Sequence
  mRNA product Design5 comprising derived and/or modified sequence from Homo sapiens__NP_001423.1__HsEREG (opt1)
gggagagucccgcagucggcguccagcggcucugcuuguucgugugugugucguugcaggccuuauucaagcuuaccaugaccgccggccgccggauggagaugcugugcgccgggcgcgugcccgcgcuccugcugugccucggcuuccaccuccugcaggccguccugagcaccacggugaucccguccugcauccccggggagagcuccgacaacugcaccgcccuggugcagaccgaggacaacccccgggucgcccaggugagcaucaccaagugcuccagcgacaugaacggcuacugccugcacgggcagugcaucuaccucguggacaugucccagaacuacugccgcugcgaggucggcuacacgggcgugcggugcgagcacuucuuccugaccgugcaccagccccugagcaaggaguacgucgcccucaccgugauccugaucauccuguuccucaucaccguggucggguccacguacuacuucugccgcugguaccggaaccgcaagagcaaggagccgaagaaggaguacgagcgggugaccuccggcgaccccgagcugccccaggugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6360 - RNA, 744 nt, Artificial Sequence
  mRNA product Design5 comprising derived and/or modified sequence from Homo sapiens__NP_000791.1__HsFGF1 (opt1)
gggagagucccgcagucggcguccagcggcucugcuuguucgugugugugucguugcaggccuuauucaagcuuaccauggccgagggcgagaucaccaccuucacggcccugaccgagaaguucaaccugcccccggggaacuacaagaagcccaagcuccuguacugcagcaacggcgggcacuuccuccgcauccugcccgacggcaccguggacgggacccgggaccgcuccgaccagcacauccagcugcagcucagcgcggaguccgucggcgagguguacaucaagagcacggagaccggccaguaccuggccauggacaccgacgggcugcucuacggcucccagacccccaacgaggagugccuguuccuggagcggcucgaggagaaccacuacaacacguacaucagcaagaagcacgccgagaagaacugguucguggggcugaagaagaacggcuccugcaagcgcgggccgcggacccacuacggccagaaggccauccuguuccucccccugcccgucagcuccgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6361 - RNA, 1143 nt, Artificial Sequence
  mRNA product Design5 comprising derived and/or modified sequence from Homo sapiens__NP_001997.5__HsFGF2 (opt1)
gggagagucccgcagucggcguccagcggcucugcuuguucgugugugugucguugcaggccuuauucaagcuuaccauggugggcgucgggggcggggacguggaggacgugaccccgcgcccgggcgggugccagaucagcggccggggcgcccgcgggugcaacggcauccccggggccgcggccugggaggccgcccugccccggcgccggccccgccggcacccguccgucaacccccgcagccgggccgcgggcagcccccgcacccgggggcgccggacggaggagcgccccuccggcucccggcucggcgaccgcgggcggggccgcgcccugcccgggggccggcugggcgggcgcggccgggggcgcgcccccgagcgcgugggcgggcggggccgcggccgggggaccgccgcgccccgcgccgcccccgccgcccggggcagccgcccggggcccgcgggcaccauggccgccggguccaucaccacgcuccccgcccugcccgaggacggcggcagcggggccuucccgcccggccacuucaaggaccccaagcggcuguacugcaagaacgggggcuucuuccuccgcauccaccccgacgggcggguggacggcguccgcgagaaguccgacccgcacaucaagcugcagcugcaggcggaggagcggggcguggugagcaucaagggggucugcgccaaccgcuaccucgccaugaaggaggacggccggcugcuggccuccaagugcgugaccgacgagugcuucuucuucgagcgccucgagagcaacaacuacaacaccuaccggucccgcaaguacaccagcugguacguggcccugaagcggacggggcaguacaagcugggcuccaagaccggccccgggcagaaggcgauccucuuccugcccaugagcgccaaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6362 - RNA, 861 nt, Artificial Sequence
  mRNA product Design5 comprising derived and/or modified sequence from Homo sapiens__NP_002000.1__HsFGF7 (opt1)
gggagagucccgcagucggcguccagcggcucugcuuguucgugugugugucguugcaggccuuauucaagcuuaccaugcacaaguggauccugaccuggauccuccccacccugcuguaccgcagcugcuuccacaucaucugccucgugggcacgaucucccuggccugcaacgacaugaccccggagcagauggccaccaacgucaacugcagcucccccgagcggcacacccgcagcuacgacuacauggagggcggggacauccgggugcgccggcuguucugccgcacgcagugguaccuccggaucgacaagcgcgggaaggugaagggcacccaggagaugaagaacaacuacaacaucauggagauccggaccgucgcgguggggaucguggccaucaagggcgucgaguccgaguucuaccuggccaugaacaaggagggcaagcuguacgccaagaaggagugcaacgaggacugcaacuucaaggagcucauccuggagaaccacuacaacaccuacgccagcgcgaaguggacgcacaacgggggcgagauguucguggcccugaaccagaaggggauccccgugcgcggcaagaagaccaagaaggagcagaagaccgcccacuuccuccccauggccaucaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6363 - RNA, 903 nt, Artificial Sequence
  mRNA product Design5 comprising derived and/or modified sequence from Homo sapiens__NP_001936.1__HsHBEGF (opt1)
gggagagucccgcagucggcguccagcggcucugcuuguucgugugugugucguugcaggccuuauucaagcuuaccaugaagcugcuccccagcgugguccugaagcuguuccucgccgccgugcuguccgcgcuggugaccggcgagagccucgagcggcugcggcgcgggcuggccgccggcaccuccaacccggacccgcccacggucagcaccgaccagcuccugccccucgggggcgggcgggaccgcaaggugcgggaccugcaggaggccgaccuggaccugcuccgcgugacccuguccagcaagccccaggcccuggcgacccccaacaaggaggagcacggcaagcggaagaagaagggcaaggggcucggcaagaagcgcgaccccugccugcggaaguacaaggacuucugcauccacggggagugcaaguacgucaaggagcugcgcgcccccuccugcaucugccacccgggcuaccacggggagcggugccacggccucagccugcccguggagaaccgccuguacacguacgaccacaccaccauccucgccguggucgccguggugcuguccagcgucugccugcucgugaucgugggccugcugauguuccgguaccaccgccgcgggggcuacgacgucgagaacgaggagaaggugaagcucgggaugaccaacucccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6364 - RNA, 2463 nt, Artificial Sequence
  mRNA product Design5 comprising derived and/or modified sequence from Homo sapiens__NP_000592.3__HsHGF (opt1)
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaaguccgccaagacgacccugaucaagaucgaccccgcccugaagaucaagaccaagaaggugaacaccgccgaccagugcgccaaccggugcacgcgcaacaaggggcuccccuucacgugcaaggcguucguguucgacaaggcccggaagcagugccugugguucccguucaacagcaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucaccagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccucaccuacaaggugccccagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6365 - RNA, 2202 nt, Artificial Sequence
  mRNA product Design5 comprising derived and/or modified sequence from Homo sapiens__NP_005336.3 __HsHSPA1A (opt1)
gggagagucccgcagucggcguccagcggcucugcuuguucgugugugugucguugcaggccuuauucaagcuuaccauggccaaggccgcggccaucggcaucgaccuggggaccaccuacagcugcgugggcguguuccagcacgggaagguggagaucaucgccaacgaccagggcaaccgcacgacccccuccuacguggccuucaccgacaccgagcggcucaucggggacgccgcgaagaaccaggucgcccugaacccgcagaacacgguguucgacgccaagcgccugaucggccggaaguucggcgaccccgugguccagagcgacaugaagcacuggcccuuccaggugaucaacgacggggacaagcccaaggugcaggucuccuacaagggcgagaccaaggccuucuacccggaggagaucagcuccauggugcucaccaagaugaaggagaucgcggaggccuaccugggguaccccgugaccaacgccgucaucacggugcccgccuacuucaacgacagccagcgccaggccaccaaggacgcgggcgugaucgccgggcugaacguccuccggaucaucaacgagcccaccgccgccgccaucgcguacggccuggaccgcaccggcaagggggagcggaacgugcugaucuucgaccucggcgggggcacguucgacguguccauccugaccaucgacgacggcaucuucgaggucaaggccaccgccggggacacccaccugggcggggaggacuucgacaaccgccucgugaaccacuucguggaggaguucaagcggaagcacaagaaggacaucagccagaacaagcgcgccguccggcgccugcggacggccugcgagcgcgcgaagcggacccuguccagcuccacccaggccagccucgagaucgacucccuguucgagggcaucgacuucuacaccagcaucacgcgcgcccgguucgaggagcugugcuccgaccucuuccgcagcacccuggagccgguggagaaggcccugcgggacgccaagcucgacaaggcgcagauccacgaccuggugcuggucgggggcuccacccgcauccccaaggugcagaagcuccugcaggacuucuucaacggccgggaccugaacaagagcaucaaccccgacgaggccgucgccuacggggccgcggugcaggccgccauccucaugggcgacaaguccgagaacgugcaggaccugcugcuccuggacgucgcgccccugagccucgggcuggagaccgccggcggggugaugacggcccugaucaagcgcaacagcaccaucccgaccaagcagacccagaucuucacgaccuacuccgacaaccagcccggcgugcucauccaggucuacgagggcgagcgcgccaugaccaaggacaacaaccugcuggggcgguucgagcucagcggcaucccgcccgcgccccgcggggugccccagaucgaggugaccuucgacaucgacgccaacggcauccugaacgucacggccaccgacaaguccaccgggaaggccaacaagaucaccaucacgaacgacaagggccggcugagcaaggaggagaucgagcgcauggugcaggaggccgagaaguacaaggccgaggacgaggugcagcgggagcgcgucuccgccaagaacgcccucgagagcuacgcguucaacaugaaguccgccguggaggacgagggccugaaggggaagaucagcgaggccgacaagaagaaggugcuggacaagugccaggaggucaucuccuggcucgacgccaacacccuggcggagaaggacgaguucgagcacaagcggaaggagcuggagcaggucugcaaccccaucaucagcggccucuaccagggggccggcggccccgggccgggcggguucggcgcccaggggcccaagggcggcuccgggagcggccccaccaucgaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6366 - RNA, 2202 nt, Artificial Sequence; identical to SEQ ID NO: 6365
  mRNA product Design5 comprising derived and/or modified sequence from Homo sapiens__NP_005337.2 __HsHSPA1B (opt1)

SEQ ID NO: 6367 - RNA, 2202 nt, Artificial Sequence
  mRNA product Design5 comprising derived and/or modified sequence from Homo sapiens__NP_005518.3 __HsHSPA1L (opt1)
gggagagucccgcagucggcguccagcggcucugcuuguucgugugugugucguugcaggccuuauucaagcuuaccauggccaccgccaagggcaucgcgaucgggaucgaccugggcaccacguacagcugcgugggggucuuccagcacggcaagguggagaucaucgccaacgaccaggggaaccgcaccacccccuccuacguggccuucaccgacacggagcggcucaucggcgacgccgccaagaaccaggucgcgaugaacccgcagaacaccguguucgacgccaagcgccugaucggccggaaguucaacgaccccgugguccaggccgacaugaagcuguggcccuuccaggugaucaacgagggcgggaagcccaaggugcucgucagcuacaagggggagaacaaggccuucuacccggaggagaucuccagcauggugcugaccaagcugaaggagaccgcggaggccuuccucggccaccccgugacgaacgccgucaucaccgugcccgccuacuucaacgacucccagcgccaggccaccaaggacgcgggggugaucgccggccugaacguccugcggaucaucaacgagcccaccgccgccgccaucgcguacggccucgacaagggcgggcagggggagcgccacgugcugaucuucgaccugggcggcgggacguucgacgugagcauccucaccaucgacgacggcaucuucgaggucaaggccaccgccggggacacccaccugggcggggaggacuucgacaaccggcuggugucccacuucguggaggaguucaagcgcaagcacaagaaggacaucagccagaacaagcgggccguccgccggcuccgcacggccugcgagcgggcgaagcgcacccuguccagcuccacccaggccaaccuggagaucgacagccucuacgagggcaucgacuucuacaccuccaucacgcgggcccgcuucgaggagcugugcgccgaccuguuccggggcacccucgagccgguggagaaggcccugcgcgacgcgaagauggacaaggccaagauccacgacaucgugcuggucgggggcagcacccggauccccaaggugcagcgccuccugcaggacuacuucaacgggcgggaccugaacaaguccaucaaccccgacgaggccgucgccuacggcgcggccgugcaggccgccauccucaugggggacaagagcgagaaggugcaggaccugcugcuccuggacgucgcgccccugucccucggccuggagaccgccggcggggugaugacggcccugaucaagcgcaacagcaccaucccgaccaagcagacccagaucuucacgaccuacuccgacaaccagcccggcgugcucauccaggucuacgagggggagcgcgccaugaccaaggacaacaaccugcugggccgguucgaccucaccgggaucccgcccgcgccccgcggcgugccccagaucgaggugacguucgacaucgacgccaacggcauccugaacgucaccgccaccgacaagagcaccgggaaggugaacaagaucacgaucaccaacgacaagggccggcugagcaaggaggagaucgagcgcauggugcucgacgccgagaaguacaaggccgaggacgagguccagcgggagaagaucgccgccaagaacgcgcuggaguccuacgccuucaacaugaaguccguggugagcgacgaggggcugaagggcaagaucagcgaguccgacaagaacaagauccucgacaagugcaacgagcugcugagcuggcucgaggucaaccagcuggccgagaaggacgaguucgaccacaagcgcaaggagcuggagcagaugugcaaccccaucaucaccaagcuguaccagggcgggugcaccggccccgccugcgggaccggcuacgugccggggcggcccgcgacgggccccaccaucgaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6368 - RNA, 2196 nt, Artificial Sequence
  mRNA product Design5 comprising derived and/or modified sequence from Homo sapiens__NP_068814.2 __HsHSPA2 (opt1)
gggagagucccgcagucggcguccagcggcucugcuuguucgugugugugucguugcaggccuuauucaagcuuaccaugagcgcccgcggccccgccaucgggaucgaccugggcaccaccuacuccugcgugggggucuuccagcacggcaagguggagaucaucgcgaacgaccaggggaaccggacgaccccgagcuacguggccuucaccgacaccgagcgccucaucggcgacgccgccaagaaccaggucgccaugaaccccacgaacaccaucuucgacgcgaagcggcugaucggccgcaaguucgaggacgccaccgugcaguccgacaugaagcacuggcccuuccggguggucagcgagggcgggaagcccaagguccagguggaguacaagggggagaccaagacguucuucccggaggagaucuccagcauggugcugaccaagaugaaggagaucgccgaggccuaccucggcgggaaggugcacuccgcggugaucaccguccccgccuacuucaacgacagccagcgccaggccaccaaggacgccggcacgaucaccggccugaacgugcugcggaucaucaacgagcccaccgccgcggccaucgccuacgggcucgacaagaagggcugcgccgggggcgagaagaacgugcugaucuucgaccugggcgggggcaccuucgacgucuccauccucacgaucgaggacgggaucuucgaggucaagagcaccgccggcgacacccaccucgggggcgaggacuucgacaaccgcauggugucccaccuggcggaggaguucaagcggaagcacaagaaggacaucggccccaacaagcgcgccgugcggcgccugcggaccgccugcgagcgcgccaagcggacgcugagcuccagcacccaggccuccaucgagaucgacagccuguacgaggggguggacuucuacaccuccaucacccgcgcgcgguucgaggagcucaacgccgaccuguuccgcggcacgcuggagccgguggagaaggcccuccgggacgccaagcuggacaaggggcagauccaggagaucguccuggugggcgggagcacccgcauccccaagauccagaagcuccugcaggacuucuucaacggcaaggagcugaacaaguccaucaaccccgacgaggccguggcguacggcgccgccguccaggccgcgauccucaucggggacaagagcgagaacgugcaggaccugcugcuccuggacgucacgccccugagccucggcaucgagaccgccgggggcgugaugaccccgcugaucaagcggaacaccaccauccccaccaagcagacgcagaccuucaccaccuacuccgacaaccagagcuccgugcugguccagguguacgagggggagcgcgccaugacgaaggacaacaaccuccugggcaaguucgaccugaccggcaucccgcccgcgccccgcggggugccccagaucgaggucaccuucgacaucgacgccaacggcauccucaacgugaccgccgccgacaagagcaccgggaaggagaacaagaucacgaucaccaacgacaagggccggcuguccaaggacgacaucgaccgcauggugcaggaggccgagcgguacaagagcgaggacgaggccaaccgcgaccgggucgccgcgaagaacgcccuggaguccuacaccuacaacaucaagcagaccguggaggacgagaagcuccgcggcaagaucagcgagcaggacaagaacaagauccuggacaagugccaggaggugaucaacuggcuggaccggaaccagauggccgagaaggacgaguacgagcacaagcagaaggagcucgagcgcgucugcaaccccaucaucuccaagcuguaccagggcgggcccgggggcgggagcggcggcgggggcuccggggccagcggcgggccgacgaucgaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6369 - RNA, 2799 nt, Artificial Sequence
  mRNA product Design5 comprising derived and/or modified sequence from Homo sapiens__NP_002145.3 __HsHSPA4 (opt1)
gggagagucccgcagucggcguccagcggcucugcuuguucgugugugugucguugcaggccuuauucaagcuuaccaugagcguggucggcaucgaccugggguuccaguccugcuacguggccguggcccgcgcgggcgggaucgagaccaucgccaacgaguacagcgaccggugcacccccgccugcaucuccuucggcccgaagaaccgcagcaucggggccgccgcgaagucccaggucaucagcaacgccaagaacacggugcagggcuucaagcgguuccacggccgcgccuucuccgaccccuucguggaggccgagaaguccaaccucgcguacgacaucguccagcugcccaccgggcugaccggcaucaaggugaccuacauggaggaggagcggaacuucacgaccgagcaggucaccgccaugcuccugagcaagcugaaggagaccgccgagagcgugcucaagaagcccgugguggacugcgucguguccgugccgugcuucuacacggacgccgagcgccggagcgucauggacgccacccagaucgcggggcugaacugccugcgccucaugaacgagaccaccgccguggcccuggccuacggcaucuacaagcaggaccugcccgcccucgaggagaagccccggaacguggucuucguggacauggggcacuccgcguaccaggugagcgucugcgccuucaaccgcggcaagcugaaggugcuggccacggccuucgacaccacccucggcgggcggaaguucgacgaggugcuggucaaccacuucugcgaggaguucggcaagaaguacaagcuggacaucaaguccaagauccgcgcccuccugcggcugagccaggagugcgagaagcucaagaagcugauguccgcgaacgccagcgaccugccccucuccaucgagugcuucaugaacgacguggacgucagcgggaccaugaaccgcggcaaguuccuggagaugugcaacgaccugcucgcccggguggagccgccccugcgcagcgugcuggagcagacgaagcucaagaaggaggacaucuacgccgucgagaucgugggcggggccacccggauccccgcggugaaggagaagaucuccaaguucuucggcaaggagcugagcaccacccugaacgccgacgaggccgucacgcgcgggugcgcccuccagugcgcgauccugucccccgccuucaaggugcgggaguucagcaucaccgacguggucccguaccccaucucccugcgcuggaacagccccgccgaggagggcuccagcgacugcgagguguucuccaagaaccacgccgcccccuucagcaaggugcucaccuucuaccggaaggagccguucacccuggaggcguacuacuccagcccccaggaccugcccuaccccgacccggccaucgcccaguucuccguccagaaggugacgccccagagcgacggguccagcuccaaggugaaggucaaggugcgcgugaacguccacggcaucuucagcguguccagcgccagccucguggagguccacaaguccgaggagaacgaggagcccauggagaccgaccagaacgccaaggaggaggagaagaugcaggucgaccaggaggagccccacguggaggagcagcagcagcagaccccggcggagaacaaggccgagagcgaggagauggagaccucccaggccggcagcaaggacaagaagauggaccagccgccccaggccaagaaggccaaggugaagacguccaccguggaccugcccaucgagaaccagcugcucuggcagaucgaccgcgagaugcugaaccuguacaucgagaacgaggggaagaugaucaugcaggacaagcucgagaaggagcggaacgacgcgaagaacgccguggaggaguacgucuacgagaugcgcgacaagcugagcggcgaguacgagaaguucguguccgaggacgaccggaacagcuucacccugaagcucgaggacaccgagaacuggcuguacgaggacggggaggaccagcccaagcaggucuacguggacaagcuggccgagcugaagaaccucggccagcccaucaagauccgcuuccaggaguccgaggagcggcccaagcuguucgaggagcuggggaagcagauccagcaguacaugaagaucaucagcuccuucaagaacaaggaggaccaguacgaccaccucgacgccgcggacaugacgaagguggagaaguccaccaacgaggccauggaguggaugaacaacaagcugaaccugcagaacaagcagagccucaccauggacccgguggucaagagcaaggagaucgaggccaagaucaaggagcugaccuccacgugcagccccaucaucuccaagcccaagcccaagguggagccgcccaaggaggagcagaagaacgccgagcagaacggccccguggacggccagggggacaaccccggcccgcaggccgcggagcaggggaccgacaccgccguccccagcgacagcgacaagaagcugcccgagauggacaucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6370 - RNA, 2796 nt, Artificial Sequence
  mRNA product Design5 comprising derived and/or modified sequence from Homo sapiens__NP_055093.2 __HsHSPA4L (opt1)
gggagagucccgcagucggcguccagcggcucugcuuguucgugugugugucguugcaggccuuauucaagcuuaccaugagcguggucggcaucgaccugggguuccucaacugcuacaucgccguggcccgcuccggcgggaucgagaccaucgcgaacgaguacagcgaccggugcacccccgccugcaucucccugggcagccgcacgcgggccaucgggaacgccgccaagucccagaucgugaccaacguccgcaacaccauccacggcuucaagaagcugcacggccggagcuucgacgacccgaucgugcagaccgagcgcauccggcuccccuacgagcugcagaagaugcccaacggguccgcgggcgugaagguccgcuaccuggaggaggagcggcccuucgccaucgagcaggucacggggaugcuccuggccaagcugaaggagaccagcgagaacgcccucaagaagccgguggcggacugcgugaucuccauccccagcuucuucaccgacgccgagcgccgguccgugauggccgccgcccagguggcgggccugaacugccugcgccucaugaacgagaccacggccgucgcccuggccuacgggaucuacaagcaggaccugccgccccucgacgagaagccccggaacgugguguucaucgacaugggccacagcgccuaccagguccuggugugcgcguucaacaagggcaagcugaaggugcucgccaccaccuucgaccccuaccucgggggccgcaacuucgacgaggcccuggucgacuacuucugcgacgaguucaagaccaaguacaagaucaacgugaaggagaacucccgggcccugcugcgccuguaccaggagugcgagaagcucaagaagcugaugagcgccaacgcguccgaccugccccucaacaucgagugcuucaugaacgaccuggacgugagcuccaagaugaaccgggcccaguucgagcagcugugcgccagccuccuggcccgcgucgagcccccgcugaaggccgugauggagcaggcgaaccuccagcgggaggacaucuccagcaucgagaucgucgggggcgccacgcgcauccccgccgugaaggagcagaucaccaaguucuuccugaaggacaucagcaccacccugaacgccgacgaggcgguggcccggggcugcgcccuccagugcgccauccugucccccgccuucaagguccgcgaguucagcaucacggaccuggugcccuacuccaucacccuccgcuggaagaccagcuucgaggacggguccggcgagugcgagguguucugcaagaaccacccggcgcccuucagcaaggucaucaccuuccacaagaaggagcccuucgagcuggaggccuucuacacgaaccugcacgaggugcccuacccggacgcccggaucggguccuucaccauccagaacguguucccccagagcgacggcgacuccagcaaggucaaggugaaggugcgcgucaacauccacgggaucuucuccguggccagcgccuccgugaucgagaagcagaaccucgagggcgaccacagcgacgcgcccauggagaccgagaccuccuucaagaacgagaacaaggacaacauggacaagaugcaggucgaccaggaggagggccaccagaagugccacgccgagcacacgcccgaggaggagaucgaccacaccggggccaagaccaagagcgccguguccgacaagcaggaccggcugaaccagacccugaagaagggcaaggucaagagcaucgaccucccgauccaguccagccugugccgccagcuggggcaggaccuccugaacagcuacaucgagaacgagggcaagaugaucaugcaggacaagcuggagaaggagcggaacgacgccaagaacgcgguggaggaguacguguacgacuuccgcgaccggcuggggacgguguacgagaaguucaucacccccgaggaccucuccaagcugagcgccguccuggaggacaccgagaacuggcucuacgaggacggcgaggaccagcccaagcaggucuacguggacaagcugcaggagcugaagaaguacggccagcccauccagaugaaguacauggagcacgaggagcgcccgaaggcccucaacgaccuggggaagaagauccagcuggugaugaaggugaucgaggccuaccggaacaaggacgagcgcuacgaccaccucgaccccaccgagauggagaagguggagaagugcaucuccgacgcgaugagcuggcugaacuccaagaugaacgcccagaacaagcugagccucacgcaggaccccgucgugaagguguccgagaucgucgccaagagcaaggagcuggacaacuucugcaacccgaucaucuacaagcccaagcccaaggccgaggugcccgaggacaagccgaaggccaacuccgagcacaacggccccauggacgggcagagcggcaccgagaccaaguccgacagcaccaaggacuccagccagcacacgaaguccagcggggagauggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6371 - RNA, 2241 nt, Artificial Sequence
  mRNA product Design5 comprising derived and/or modified sequence from Homo sapiens__NP_005338.1__HsHSPA5 (opt1)
gggagagucccgcagucggcguccagcggcucugcuuguucgugugugugucguugcaggccuuauucaagcuuaccaugaagcugagccucguggccgccaugcugcugcuccuguccgcggcccgcgccgaggaggaggacaagaaggaggacgucggcaccgugguggggaucgaccugggcaccacguacagcugcgucgggguguucaagaacggccggguggagaucaucgccaacgaccaggggaaccgcaucacccccuccuacgucgccuucaccccggagggcgagcggcucaucggcgacgcggccaagaaccagcugaccagcaaccccgagaacacgguguucgacgccaagcgccugaucgggcggaccuggaacgaccccuccgugcagcaggacaucaaguuccuccccuucaaggucguggagaagaagaccaagccguacauccagguggacaucggcgggggccagaccaagacguucgcccccgaggagaucagcgcgaugguccugaccaagaugaaggagaccgccgaggccuaccuggggaagaaggugacccacgccguggucacggugcccgccuacuucaacgacgcgcagcgccaggccaccaaggacgccggcaccaucgccggccucaacgugaugcggaucaucaacgagcccaccgccgcggccaucgccuacgggcuggacaagcgcgagggcgagaagaacauccuggucuucgaccucgggggcggcacguucgacgugucccugcugaccaucgacaacgggguguucgaggucguggccaccaacggcgacacccaccucgggggcgaggacuucgaccagcgggugauggagcacuucaucaagcuguacaagaagaagacggggaaggacguccgcaaggacaaccgggccgugcagaagcugcgccgggaggucgagaaggcgaagcgcgcccucagcucccagcaccaggcccggaucgagaucgagagcuucuacgagggcgaggacuucuccgagacccugacccgcgccaaguucgaggagcugaacauggaccucuuccggagcaccaugaagccggugcagaaggugcuggaggacuccgaccugaagaaguccgacaucgacgagaucguccucgugggcgggagcacgcgcauccccaagauccagcagcuggugaaggaguucuucaacggcaaggagcccagccgggggaucaaccccgacgaggccgucgcguacggcgccgccgugcaggccggggugcuguccggcgaccaggacaccggcgaccucguccugcuggacgugugcccgcucacccuggggaucgagaccgugggcggggucaugacgaagcugaucccccgcaacaccguggugcccaccaagaagucccagaucuucagcaccgcgagcgacaaccagcccacggucaccaucaagguguacgagggcgagcggccgcucaccaaggacaaccaccuccuggggaccuucgaccugacgggcaucccgcccgcgccccgcggcgugccccagaucgaggucaccuucgagaucgacgugaacgggauccugcgcgugaccgccgaggacaagggcaccgggaacaagaacaagaucaccaucacgaacgaccagaaccggcugacccccgaggagaucgagcgcauggucaacgacgccgagaaguucgccgaggaggacaagaagcucaaggagcggaucgacacccgcaacgagcuggagagcuacgccuacucccugaagaaccagaucggcgacaaggagaagcucggcgggaagcugagcuccgaggacaaggagaccauggagaaggccguggaggagaagaucgaguggcuggagagccaccaggacgccgacaucgaggacuucaaggccaagaagaaggagcucgaggagaucgugcagcccaucaucuccaagcuguacggcagcgccgggcccccgcccacgggcgaggaggacaccgcggagaaggacgagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6372 - RNA, 2208 nt, Artificial Sequence
  mRNA product Design5 comprising derived and/or modified sequence from Homo sapiens__NP_002146.2__HsHSPA6 (opt1)
gggagagucccgcagucggcguccagcggcucugcuuguucgugugugugucguugcaggccuuauucaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagagccaggccgcgcucaacccccacaacacgguguucgacgccaagcgccugaucggccggaaguucgccgacaccaccguccaguccgacaugaagcacuggcccuuccgcguggugagcgagggcgggaagcccaagguccgggugugcuaccgcggcgaggacaagaccuucuacccggaggagaucuccagcauggugcuguccaagaugaaggagacggccgaggcguaccucgggcagcccgucaagcacgccgugaucaccgugcccgccuacuucaacgacagccagcggcaggccaccaaggacgccggcgcgaucgccgggcugaacguccugcgcaucaucaacgagcccaccgccgccgccaucgcguacggccucgaccggcgcggcgccggggagcggaacgugcugaucuucgaccugggcgggggcacguucgacguguccguccucagcaucgacgccggcguguucgaggugaaggccaccgccggggacacccaccugggcggggaggacuucgacaaccgccuggucaaccacuucauggaggaguuccggcgcaagcacggcaaggaccucuccgggaacaagcgggcgcugcgccggcugcgcaccgccugcgagcgggccaagcgcacgcucagcuccagcacccaggccacccuggagaucgacucccuguucgagggcguggacuucuacaccagcaucacgcgcgcccgguucgaggagcucugcuccgaccuguuccgcagcacccuggagccgguggagaaggcgcuccgggacgccaagcuggacaaggcccagauccacgacgucgugcuggucggcggguccacccgcauccccaaggugcagaagcuccugcaggacuucuucaacggcaaggagcugaacaagagcaucaaccccgacgaggccguggcguacggggccgccguccaggccgccgugcucaugggcgacaagugcgagaaggugcaggaccugcugcuccuggacgucgcgccccugagccucgggcuggagaccgccggcggcgugaugacgacccugauccagcggaacgccaccaucccgaccaagcagacgcagaccuucaccaccuacuccgacaaccagcccgggguguucauccaggucuacgagggcgagcgcgccaugacgaaggacaacaaccuccuggggcgguucgagcugagcggcaucccgcccgcgccccgcggggugccccagaucgaggugaccuucgacaucgacgccaacggcauccucuccgucaccgccaccgaccggagcacgggcaaggccaacaagaucaccaucaccaacgacaaggggcgccuguccaaggaggagguggagcggauggugcacgaggccgagcaguacaaggccgaggacgaggcgcagcgcgaccgggucgccgccaagaacagccuggaggcccacguguuccacgugaagggcucccuccaggaggagagccugcgcgacaagauccccgaggaggaccggcgcaagaugcaggacaagugccgggagguccuggcguggcucgagcacaaccagcuggccgagaaggaggaguacgagcaccagaagcgcgagcuggagcagaucugccggcccaucuucucccgccuguacgggggcccgggcgugcccgggggcagcuccugcgggacccaggcccgccagggcgaccccagcaccgggcccaucaucgaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6373 - RNA, 1380 nt, Artificial Sequence
  mRNA product Design5 comprising derived and/or modified sequence from Homo sapiens__P48741__HsHSPA7 (opt1)
gggagagucccgcagucggcguccagcggcucugcuuguucgugugugugucguugcaggccuuauucaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagagccaggccgcgcucaacccccacaacacgguguucgacgccaagcgccugaucggccggaaguucgccgacaccaccguccaguccgacaugaagcacuggcccuuccagguggugagcgagggcgggaagcccaagguccgcgugugcuaccggggcgaggacaagaccuucuacccggaggagaucuccagcauggugcuguccaagaugaaggagacggccgaggcguaccucgggcagcccgucaagcacgccgugaucaccgugcccaccuacuucagcaacucccagcgccaggccaccaaggacgccggcgccaucgcggggcugaagguccugcccaucaucaacgaggccacggccgccgccaucgcguacggccucgaccggcgcggcgccgggaagcggaacgugcugaucuucgaccugggcgggggcaccuucgacgugagcguccucuccaucgacgccggcguguucgaggugaaggccaccgccggggacacccaccugggcggggaggacuucgacaaccgccuggucaaccacuucauggaggaguuccggcgcaagcacggcaaggaccucagcgggaacaagcgggcgcugcgccggcugcgcacggccugcgagcgggccaagcgcaccccguccagcuccacccaggccacccucgagaucgacagccuguucgagggcguggacuucuacaaguccaucacgcgggcccgcuucgaggagcugugcagcgaccucuuccgcuccacccuggagcccguggagaaggcgcugcgggacgccaagcucgacaaggcccagauccacgacuucguccugggcgggggccugcacagccacccccagggggccgagguggcggccggccuccugcagcgccagggggccgagcaggagcaccagcccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6374 - RNA, 2217 nt, Artificial Sequence
  mRNA product Design5 comprising derived and/or modified sequence from Homo sapiens__NP_006588.1 __HsHSPA8 (opt1)
gggagagucccgcagucggcguccagcggcucugcuuguucgugugugugucguugcaggccuuauucaagcuuaccaugagcaagggccccgccguggggaucgaccugggcaccaccuacuccugcgucgggguguuccagcacggcaagguggagaucaucgccaacgaccaggggaaccgcacgacccccagcuacgucgcguucaccgacaccgagcggcucaucggcgacgccgccaagaaccagguggccaugaaccccacgaacaccguguucgacgccaagcgccugaucggccggcgcuucgacgacgcggucgugcaguccgacaugaagcacuggcccuucaugguggucaacgacgccgggcggcccaagguccagguggaguacaagggcgagaccaagagcuucuacccggaggagguguccagcauggugcugaccaagaugaaggagaucgccgaggccuaccucgggaagacggugaccaacgcggucgugaccgugcccgccuacuucaacgacucccagcgccaggccaccaaggacgccggcacgaucgccgggcugaacguccugcggaucaucaacgagcccaccgcggccgccaucgccuacggccucgacaagaaggugggcgccgagcgcaacgugcugaucuucgaccucgggggcgggaccuucgacgucagcauccugaccaucgaggacggcaucuucgaggugaaguccacggcgggcgacacccaccucgggggcgaggacuucgacaaccggauggugaaccacuucaucgccgaguucaagcgcaagcacaagaaggacaucagcgagaacaagcgggccguccgccggcugcgcaccgccugcgagcgggccaagcgcacccuguccagcuccacgcaggcgagcaucgagaucgacucccuguacgaggggaucgacuucuacaccagcaucacccgggcccgcuucgaggagcugaacgccgaccucuuccggggcacccuggaccccguggagaaggcccugcgcgacgccaagcucgacaagucccagauccacgacaucguccuggucgggggcagcacgcggaucccgaagauccagaagcugcuccaggacuucuucaacggcaaggagcugaacaaguccaucaaccccgacgaggcgguggccuacggggccgccgugcaggcggccauccugagcggcgacaagagcgagaacgugcaggaccuccugcugcucgacgugacgccccugucccuggggaucgagaccgccggcggggucaugaccgugcucaucaagcgcaacaccaccauccccaccaagcagacccagacguucaccaccuacagcgacaaccagccgggcgugcugauccaggucuacgagggcgagcgcgccaugaccaaggacaacaaccugcucgggaaguucgagcugacgggcaucccgcccgcgccccgcggggugccccagaucgaggugaccuucgacaucgacgccaacggcauccugaacgucuccgccguggacaagagcaccgggaaggagaacaagaucaccaucaccaacgacaagggccggcucuccaaggaggacaucgagcggauggugcaggaggccgagaaguacaaggccgaggacgagaagcagcgcgacaaggucagcuccaagaacagccuggaguccuacgccuucaacaugaaggcgacgguggaggacgagaagcugcagggcaagaucaacgacgaggacaagcagaagauccucgacaagugcaacgagaucaucaacuggcuggacaagaaccagaccgccgagaaggaggaguucgagcaccagcagaaggagcuggagaaggugugcaaccccaucaucaccaagcucuaccagagcgccgggggcaugcccgggggcaugcccggcggguucccgggcgggggcgccccgcccuccgggggcgccagcuccggccccaccaucgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6375 - RNA, 2316 nt, Artificial Sequence
  mRNA product Design5 comprising derived and/or modified sequence from Homo sapiens__NP_004125.3 __HsHSPA9 (opt1)
gggagagucccgcagucggcguccagcggcucugcuuguucgugugugugucguugcaggccuuauucaagcuuaccaugaucagcgccucccgcgccgcggccgcccggcuggugggcgccgccgcgagccgcgggcccaccgccgcccggcaccaggacuccuggaacggccucagccacgaggccuuccgccuggucucccggcgcgacuacgcgagcgaggccaucaagggggccguggugggcaucgaccuggggaccacgaacuccugcgucgccgugauggagggcaagcaggccaaggugcucgagaacgcggagggcgcccggaccaccccgagcgucguggccuucaccgccgacggggagcgccuggugggcaugcccgccaagcggcaggcggucacgaaccccaacaacaccuucuacgccaccaagcgccugaucgggcggcgcuacgacgaccccgaggugcagaaggacaucaagaacgugccguucaagaucguccgggccuccaacggcgacgccuggguggaggcccacgggaagcucuacagccccucccagaucggcgcguucgugcugaugaagaugaaggagaccgccgagaacuaccugggccacacggccaagaacgccgucaucaccgugcccgccuacuucaacgacagccagcgccaggcgaccaaggacgccgggcagaucuccggccucaacgugcugcgggucaucaacgagcccaccgccgccgcgcuggccuacgggcucgacaagagcgaggacaaggugaucgccguguacgaccugggcggcgggacguucgacaucuccauccuggagauccagaagggcgucuucgaggucaagagcaccaacggggacaccuuccucggcggggaggacuucgaccaggcccugcugcgccacaucgugaaggaguucaagcgggagaccggcguggaccucacgaaggacaacauggcccugcagcgcgugcgggaggcggccgagaaggccaagugcgagcuguccagcuccguccagaccgacaucaaccucccguaccugaccauggacagcagcggccccaagcaccugaacaugaagcucacccgcgcccaguucgaggggaucgugacggaccugauccggcgcaccaucgcccccugccagaaggcgaugcaggacgccgagguguccaagagcgacaucggcgaggucauccuggucgggggcaugacccgcaugcccaaggugcagcagaccgugcaggaccucuucgggcgggccccguccaaggccgugaaccccgacgaggccguggcgaucggcgccgccauccagggcgggguccuggccggcgacgugacggacgugcugcuccuggacgucacgccccugagccucgggaucgagacccugggcgggguguucaccaagcugaucaaccgcaacaccaccauccccaccaagaagucccagguguucagcaccgcggccgacggccagacgcaggucgagaucaaggugugccagggcgagcgggagauggccggggacaacaagcuccugggccaguucacccugaucgggaucccgcccgcgccccgcggcgugccccagaucgaggucaccuucgacaucgacgccaacggcaucgugcacguguccgccaaggacaaggggaccggccgggagcagcagaucgucauccagagcuccgggggccucagcaaggacgacaucgagaacauggugaagaacgccgagaaguacgccgaggaggaccgccggaagaaggagcgcguggaggccgucaacauggccgaggggaucauccacgacacggagaccaagauggaggaguucaaggaccagcugccggcggacgagugcaacaagcugaaggaggagaucuccaagaugcgggagcuccuggcccgcaaggacagcgagaccggcgagaacauccggcaggccgccuccagccugcagcaggccucccucaagcuguucgagauggcguacaagaagauggccagcgagcgcgagggcuccgggagcuccggcaccggggagcagaaggaggaccagaaggaggagaagcagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6376 - RNA, 2304 nt, Artificial Sequence
  mRNA product Design5 comprising derived and/or modified sequence from Homo sapiens__NP_079291.2__HsHSPA12A (opt1)
gggagagucccgcagucggcguccagcggcucugcuuguucgugugugugucguugcaggccuuauucaagcuuaccauggccgacaaggaggccggcgggagcgacggcccccgcgagaccgcgccgaccuccgccuacagcucccccgcccggagccugggggacacgggcaucacgccccucucccccagccacaucgugaacgacaccgacuccaacgucagcgagcagcaguccuuccuggugguggucgccguggacuucgggaccaccagcuccggcuacgccuacagcuucaccaaggagccggagugcauccacgugaugcgccggugggagggcggggaccccggcgucuccaaccagaagacccccaccacgauccugcucacccccgagcgcaaguuccacagcuucggguacgcggcccgggacuucuaccacgaccuggacccgaacgaggccaagcaguggcuguaccucgagaaguucaagaugaagcugcacaccaccggcgaccugacgauggacaccgaccucaccgccgcgaacgggaagaaggugaaggcccuggagaucuucgccuacgcccugcaguacuucaaggagcaggcccucaaggagcuguccgaccaggcgggcagcgaguucgagaacuccgacgugcgcugggucaucaccgugcccgccaucuggaagcagcccgccaagcaguucaugcggcaggccgccuaccaggcgggccuggccagccccgagaacuccgagcagcucaucaucgcccuggagccggaggccgccagcaucuacugccgcaagcugcggcuccaccagaugaucgagcugagcuccaaggcggccgugaacggguacagcggcuccgacacggucggggccggcuucacccaggccaaggagcacauccgccggaaccgccagagccggaccuuccugguggagaacgugaucggcgagaucugguccgagcucgaggagggggacaaguacgucgugguggacagcggcgggggcaccgucgaccugacggugcaccagauccgccugcccgaggggcaccucaaggagcuguacaaggccaccggcggccccuacgggucccugggcguggacuacgaguucgagaagcuccuguacaagaucuucggggaggacuucaucgagcaguucaagaucaagcggcccgcggccugggucgaccugaugaucgccuucgagagccgcaagcgggccgcggccccggaccgcaccaacccccucaacaucacccugcccuucuccuucaucgacuacuacaagaaguuccggggccacagcguggagcacgcccugcgcaaguccaacguggacuucgucaaguggagcucccaggggaugcuccggaugagccccgacgccaugaacgcccuguucaagccgacgaucgacuccaucaucgagcaccuccgcgaccuguuccagaagcccgaggugagcaccgucaaguuccuguuccuggugggcggcuucgcggaggcgccccuccugcagcaggccgugcaggccgccuucggggaccagugccgcaucaucaucccccaggacgucggccugaccauccucaagggggccgugcuguucggccuggacccggccgugaucaagguccggcgcagcccccucaccuacggggugggcgugcugaaccgguacgucgagggcaagcacccgcccgagaagcugcucgugaaggacgggacgcgcuggugcaccgacguguucgacaaguucaucuccgccgaccaguccgucgcccugggcgagcuggugaagcggagcuacacccccgccaagcccagccagcuggugaucgucaucaacaucuacuccagcgagcacgacaacguguccuucaucaccgaccccggggugaagaagugcggcacgcuccgccuggaccugaccggcaccagcgggaccgcggucccggcccggcgcgagauccagacgcucaugcaguucggcgacaccgagaucaaggccaccgccaucgacaucgcgaccuccaagagcgugaagguggggaucgacuuccugaacuacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6377 - RNA, 2337 nt, Artificial Sequence
  mRNA product Design5 comprising derived and/or modified sequence from Homo sapiens__NP_443202.3 __HsHSPA12B (opt1)
gggagagucccgcagucggcguccagcggcucugcuuguucgugugugugucguugcaggccuuauucaagcuuaccaugcuggccgugcccgagaugggccuccaggggcuguacaucggcagcucccccgagcgcagccccguccccuccccgcccgggagcccccggacccaggaguccugcggcaucgccccgcugacccccagccagucccccaagcccgaggugcgcgcgccccagcaggccagcuucuccguggucguggccaucgacuucgggacgaccagcuccggcuacgccuucagcuucgccuccgaccccgaggcgauccacaugaugcggaagugggagggcggggacccgggcguggcccaccagaagaccccgaccugccuccugcugacgcccgagggggccuuccacagcuucggcuacaccgcccgcgacuacuaccacgaccucgaccccgaggaggcgcgggacuggcuguacuucgagaaguucaagaugaagauccacuccgccaccgaccugacccucaagacgcagcuggaggccgucaacgggaagaccaugcccgcccuggagguguucgcccacgcgcuccgcuucuuccgggagcacgcccugcaggagcugcgcgagcagagccccucccuccccgagaaggacaccgugcgguggguccugaccgugcccgccaucuggaagcagccggccaagcaguucaugcgcgaggccgcguaccuggccggccucgugagccgggagaacgccgagcagcugcugaucgcccucgagcccgaggccgcguccgucuacugccgcaagcugcggcugcaccagcuccuggaccugagcggccgcgcccccgggggcgggcggcucggcgagcgccggagcaucgacuccagcuuccgccaggcccgggagcagcugcgccggucccgccacagccgcacguuccugguggaguccggcgugggggagcucugggccgagaugcaggccggcgaccgguacgucguggcggacugcgggggcgggaccguggaccugaccguccaccagcuggagcagccccacggcacccucaaggagcuguacaaggccagcggcgggccguacggcgccguggggguggaccuggccuucgagcagcuccugugccgcaucuucggcgaggacuucaucgcgacguucaagcggcagcgccccgccgccugggucgaccugaccaucgccuucgaggcccggaagcgcaccgcggggccccaccgggccggcgcccucaacaucucccugcccuucagcuucaucgacuucuaccgcaagcagcggggccacaacguggagaccgcccugcgccgguccagcgugaacuucgucaagugguccagccaggggaugcuccgcauguccugcgaggccaugaacgagcuguuccagccgacggugagcggcaucauccagcacaucgaggcgcugcucgcccggcccgagguccagggggugaagcugcuguuccucgugggcggguucgccgaguccgccguccugcagcacgccgugcaggcggcccugggcgcccgcggccugcggguggucgugccccacgacguggggcucaccauccugaagggcgccguccuguucgggcaggcgccgggcguggugcgcguccggcgcagcccccucaccuacggcgugggggugcugaaccgguucguccccggccgccacccgcccgagaagcugcucgugcgcgacgggcggcgcuggugcaccgacguguucgagcgguucgucgccgccgagcaguccguggcccugggcgaggaggugcgccggagcuacugccccgcccgccccgggcagcggcgcguccugaucaaccucuacugcugcgcggccgaggacgcccgguucaucacggaccccggcgugcgcaagugcggcgcccugucccuggagcucgagccggccgacugcgggcaggacaccgcgggcgccccgcccgggcggcgcgagauccgggccgccaugcaguucggcgacaccgagaucaaggugaccgccgucgacgugagcacgaaccgcagcgugcgggcguccaucgacuuccugagcaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6378 - RNA, 1692 nt, Artificial Sequence
  mRNA product Design5 comprising derived and/or modified sequence from Homo sapiens__NP_008879.3__HsHSPA13 (opt1)
gggagagucccgcagucggcguccagcggcucugcuuguucgugugugugucguugcaggccuuauucaagcuuaccauggcccgggagaugaccauccugggcagcgccgugcucacccugcugcucgcgggguaccuggcccagcaguaccugccccucccgacgcccaaggucaucggcaucgaccuggggaccaccuacugcuccgugggcguguucuuccccgggaccggcaaggucaaggugauccccgacgagaacggccacaucagcaucccguccauggugagcuucacggacaacgacgucuacgugggguacgaguccguggagcuggccgacagcaacccccagaacaccaucuacgacgccaagcgguucaucggcaagaucuucaccgccgaggagcucgaggcggagaucgggcgcuaccccuucaagguccugaacaagaacggcaugguggaguucuccgugaccagcaacgagacgaucaccgucucccccgaguacguggggagccggcugcuccugaagcugaaggagauggccgaggccuaccucggcaugccgguggccaacgcggucaucuccgugcccgccgaguucgaccugaagcagcgcaacagcaccaucgaggccgccaaccuggccggccucaagauccugcgggugaucaacgagcccaccgcggccgccauggccuacgggcugcacaaggccgacgucuuccacgugcucgugaucgaccugggcgggggcacgcuggacgucucccuccugaacaagcagggcgggauguuccugacccgcgcgaugagcggcaacaacaagcucgggggccaggacuucaaccagcggcugcugcaguaccucuacaagcagaucuaccagaccuacggguucgugcccucccgcaaggaggagauccaccggcugcgccaggccguggagauggucaagcugaaccucacccugcaccagagcgcccagcuguccgugcuccugacggucgaggagcaggaccggaaggagccgcacagcuccgacaccgagcugcccaaggacaagcucagcagcgccgacgaccaccgcgugaacuccggcuucggccgggggcugagcgacaagaaguccggcgagagccaggugcuguucgagaccgagaucucccgcaagcuguucgacacccugaacgaggaccuguuccagaagauccucguccccauccagcagguccugaaggaggggcaccuggagaagacggagaucgacgagguggugcucgugggcgggagcacccggaucccccgcauccgccaggugauccaggaguucuucggcaaggacccgaacaccuccgucgaccccgaccuggccguggugaccggcgucgcgauccaggccgggaucgacggcgggagcuggccccuccagguguccgcccuggagauccccaacaagcaccuccagaagacgaacuucaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6379 - RNA, 1806 nt, Artificial Sequence
  mRNA product Design5 comprising derived and/or modified sequence from Homo sapiens__NP_057383.2__HsHSPA14 (opt1)
gggagagucccgcagucggcguccagcggcucugcuuguucgugugugugucguugcaggccuuauucaagcuuaccauggccgccaucggcgugcaccuggggugcaccagcgcgugcgucgccguguacaaggacggccgcgccgggguggucgccaacgacgccggcgaccgggugacccccgcgguggucgccuacuccgagaacgaggagaucguggggcucgccgccaagcagagccgcauccggaacaucuccaacacggugaugaaggucaagcagauccugggccgcagcuccagcgacccgcaggcgcagaaguacaucgccgaguccaagugccuggugaucgagaagaacggcaagcuccgguacgagaucgacaccggggaggagaccaaguucgugaaccccgaggacgucgcccgccugaucuucagcaagaugaaggagaccgcccacuccgugcugggcagcgacgccaacgacguggucaucacggugcccuucgacuucggggagaagcagaagaacgcgcucggcgaggccgcccgggccgccggguucaacgugcugcgccugauccacgagcccuccgcggcccuccuggccuacggcaucggccaggacagcccgaccgggaaguccaacauccuggucuucaagcucggcgggaccagccugucccugagcgugauggaggugaacuccggcaucuaccggguccucagcaccaacacggacgacaacaucggcggggcccacuucaccgagacccuggcccaguaccuggcguccgaguuccagcgcagcuucaagcacgacgugcggggcaacgcccgcgccaugaugaagcucaccaacagcgccgagguggccaagcacucccugagcacgcugggguccgcgaacugcuuccucgacagccuguacgagggccaggacuucgacugcaacgucucccgggcccgcuucgagcugcucugcagcccccuguucaacaagugcaucgaggccauccgggggcugcucgaccagaacggcuucaccgccgacgacaucaacaaggugguccugugcggcggguccagccgcauccccaagcugcagcagcucaucaaggaccuguuccccgcgguggagcugcucaacuccaucccgcccgacgaggugauccccaucggcgccgccaucgaggccgggauccugaucggcaaggagaaccugcucgucgaggacagccugaugaucgagugcuccgcccgggacauccuggugaaggggguggacgagagcggcgcgucccgcuucaccguccucuuccccagcggcaccccgcugcccgcccggcgccagcacacgcugcaggcccccggguccaucagcuccgugugccucgagcuguacgagagcgacggcaagaacuccgccaaggaggagaccaaguucgcccaggugguccugcaggaccucgacaagaaggagaacgggcugcgggacauccuggcggugcucaccaugaagcgcgacggcagccugcacgugaccugcacggaccaggagaccgggaagugcgaggccaucagcaucgagaucgccuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6380 - RNA, 2853 nt, Artificial Sequence
  mRNA product Design5 comprising derived and/or modified sequence from Homo sapiens__NP_006635.2 __HsHSPH1 (opt1)
gggagagucccgcagucggcguccagcggcucugcuuguucgugugugugucguugcaggccuuauucaagcuuaccaugagcguggucggccuggacguggggucccagagcugcuacaucgccguggcccgcgcgggcgggaucgagaccaucgccaacgaguucuccgaccggugcacccccagcgucaucuccuucggcagcaagaaccgcaccaucgggguggccgccaagaaccagcagaucacccacgccaacaacaccguguccaacuucaagcgguuccacggccgcgcguucaacgacccguucauccagaaggagaaggagaaccucagcuacgaccuggucccccugaagaacggcggggugggcaucaaggugauguacaugggggaggagcaccucuucuccgucgagcagaucaccgccaugcugcugacgaagcucaaggagaccgccgagaacagccugaagaagcccgugaccgacugcgugaucuccguccccagcuucuucaccgacgccgagcggcgcuccgugcuggacgcggcccagaucgugggccucaacugccugcggcugaugaacgacaugacggccgucgcccucaacuacgggaucuacaagcaggaccugccgagccuggacgagaagccccgcaucgugguguucgucgacaugggccacuccgccuuccaggugagcgcgugcgccuucaacaagggcaagcucaaggugcuggggaccgccuucgaccccuuccugggcgggaagaacuucgacgagaagcucgucgagcacuucugcgccgaguucaagaccaaguacaagcuggacgccaaguccaagauccgggcgcugcuccgccuguaccaggagugcgagaagcugaagaagcucaugagcuccaacagcaccgaccugccccugaacaucgagugcuucaugaacgacaaggacgugagcggcaagaugaaccggucccaguucgaggagcucugcgccgagcugcugcagaagaucgaggugccgcucuacagccugcuggagcagacgcaccucaaggucgaggacguguccgccgucgagaucgugggcggggccacccgcauccccgccgugaaggagcggaucgcgaaguucuucggcaaggacaucagcaccacccugaacgccgacgaggccgucgcccgcgggugcgcccugcagugcgcgauccucucccccgccuucaaggugcgggaguucagcgugacggacgccguccccuucccgaucucccugaucuggaaccacgacagcgaggacaccgagggcgugcacgagguguucucccgcaaccacgccgcgcccuucagcaagguccugaccuuccuccggcgcgggcccuucgagcuggaggccuucuacuccgacccccagggcgugccguaccccgaggccaagaucggccgguucgugguccagaacgugagcgcccagaaggacggggagaagucccgcgugaaggucaaggugcgggugaacacccacggcaucuucacgaucagcaccgccuccauggucgagaaggugcccaccgaggagaacgagaugagcuccgaggcggacauggagugccugaaccagcggcccccggagaaccccgacaccgacaagaacgugcagcaggacaacagcgaggccgggacgcagccccagguccagaccgacgcccagcagaccucccagagcccgcccagccccgagcucaccuccgaggagaacaagauccccgacgccgacaaggccaacgagaagaagguggaccagcccccggaggcgaagaagcccaagaucaagguggucaacguggagcugcccaucgaggccaaccugguguggcagcucggcaaggaccugcugaacauguacaucgagacggaggggaagaugaucaugcaggacaagcucgagaaggagcgcaacgacgccaagaacgccgucgaggaguacguguacgaguuccgcgacaagcugugcggcccguacgagaaguucaucugcgagcaggaccaccagaacuuccugcgccugcucaccgagaccgaggacuggcuguacgaggagggcgaggaccaggccaagcaggcguacguggacaagcuggaggagcucaugaagaucgggacccccgucaaggugcgguuccaggaggccgaggagcgccccaagauguucgaggagcugggccagcggcugcagcacuacgccaagaucgccgcggacuuccgcaacaaggacgagaaguacaaccacaucgacgagagcgagaugaagaagguggagaaguccgucaacgaggugauggaguggaugaacaacgugaugaacgcccaggccaagaagucccucgaccaggaccccgucgugcgggcccaggagaucaagacgaagaucaaggagcugaacaacacgugcgagccgguggucacccagcccaagcccaagaucgagagccccaagcuggagcgcaccccgaacgggcccaacaucgacaagaaggaggaggaccucgaggacaagaacaacuucggcgccgagccgccccaccagaacggggagugcuaccccaacgagaagaacagcgugaacauggaccuggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6381 - RNA, 3276 nt, Artificial Sequence
  mRNA product Design5 comprising derived and/or modified sequence from Homo sapiens__NP_006380.1 __HsHYOU1 (opt1)
gggagagucccgcagucggcguccagcggcucugcuuguucgugugugugucguugcaggccuuauucaagcuuaccauggccgacaaggugcgccggcagcgcccccggcgccgggucugcugggcccugguggcggugcuccuggccgaccugcucgcccugagcgacacccuggccgucauguccguggaccucggcagcgaguccaugaagguggccaucgucaagccgggggugcccauggagaucgugcugaacaaggagagccgccggaagacccccgucaucgugacgcugaaggagaacgagcgcuucuucggcgacuccgcggccagcauggccaucaagaaccccaaggccacccuccgguacuuccagcaccuccuggggaagcaggcggacaacccgcacguggcccuguaccaggcccgcuuccccgagcacgagcugaccuucgacccccagcggcagaccguccacuuccagaucuccagccagcugcaguucucccccgaggaggugcucggcauggugcugaacuacagccgcucccuggccgaggacuucgccgagcagccgaucaaggacgcggucaucacggugcccguguucuucaaccaggccgagcggcgcgccguccuccaggccgcccggauggcggggcugaaggugcugcagcucaucaacgacaacaccgccaccgcccugagcuacggcguguuccgccggaaggacaucaacaccacggcccagaacaucauguucuacgacaugggcuccgggagcaccgucugcaccaucgugaccuaccagauggugaagacgaaggaggccggcaugcagccccagcugcagauccgcggggucggcuucgaccggacccucgggggccuggagauggagcugcgccuccgggagcgccuggcgggccuguucaacgagcagcgcaaggggcagcgggccaaggacgugcgcgagaacccccgggccauggccaagcuccugcgcgaggccaaccggcugaagaccguccucuccgcgaacgccgaccacauggcccagaucgagggccugauggacgacguggacuucaaggccaaggugacccgcgucgaguucgaggagcugugcgcggaccucuucgagcgggugccggggcccgugcagcaggcccugcagagcgccgagaugucccuggacgagaucgagcaggucauccucgugggcggcgccacgcgcgugccccggguccaggaggugcugcugaaggccguggggaaggaggagcucggcaagaacaucaacgcggacgaggccgccgccaugggggccgucuaccaggcggccgcccugagcaaggccuucaaggugaagcccuucgugguccgcgacgccgugguguacccgauccuggucgaguucacccgggagguggaggaggagcccggcauccacucccucaagcacaacaagcgcgugcuguucagccggauggggcccuacccccagcgcaaggucaucaccuucaaccgguacagccacgacuucaacuuccacaucaacuacggcgaccugggcuuccucgggccggaggaccugcgcguguucggcucccagaaccugaccacggugaagcugaagggggucggcgacagcuucaagaaguaccccgacuacgaguccaaggggaucaaggcgcacuucaaccucgacgagagcggcgugcugucccuggaccggguggagagcgucuucgagacccucguggaggacuccgccgaggaggagagcacccugaccaagcugggcaacacgaucuccagccucuucgggggcgggaccacccccgacgccaaggagaacggcaccgacacggugcaggaggaggaggagucccccgccgaggggagcaaggacgagccgggcgagcaggucgagcugaaggaggaggcggaggcccccguggaggacggcucccagccgccgccgcccgagcccaagggggacgccacccccgagggcgagaaggccaccgagaaggagaacggggacaagagcgaggcccagaagcccuccgagaaggcggaggccggccccgagggcguggcccccgcccccgagggggagaagaagcagaagcccgcccgcaagcggcgcauggucgaggagaucggcguggagcuggugguccucgaccugcccgaccugcccgaggacaagcucgcgcagagcgugcagaagcugcaggaccugacccuccgcgaccuggagaagcaggagcgggagaaggccgccaacucccuggaggccuucaucuucgagacgcaggacaagcucuaccagccggaguaccaggaggugagcaccgaggagcagcgcgaggagaucuccgggaagcugagcgccgcgagcaccuggcuggaggacgagggcgucggggccaccacggugaugcucaaggagaagcuggccgagcugcggaagcucugccagggccuguucuuccgcguggaggagcggaagaaguggcccgagcgccuguccgcccucgacaaccugcugaaccacagcuccauguuccucaagggcgcgcggcugauccccgagauggaccagaucuucaccgaggucgagaugaccacccuggagaaggugaucaacgagaccugggccuggaagaacgccacgcucgccgagcaggccaagcugcccgcgaccgagaagccggugcugcucagcaaggacaucgaggccaagaugauggcccuggaccgcgagguccaguaccugcucaacaaggccaaguucaccaagccccggccccgccccaaggacaagaacgggacccgggccgagccgccccugaacgcguccgccagcgaccagggcgagaaggugaucccgcccgccgggcagacggaggacgccgagcccaucuccgagcccgagaagguggagaccggcagcgagcccggggacaccgagccccuggagcucggcggcccgggggccgagcccgagcagaaggagcaguccaccggccagaagcgcccccugaagaacgacgagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6382 - RNA, 2475 nt, Artificial Sequence
  mRNA product Design5 comprising derived and/or modified sequence from Homo sapiens__NP_005339.3 __HsHSP90AA1 (opt1)
gggagagucccgcagucggcguccagcggcucugcuuguucgugugugugucguugcaggccuuauucaagcuuaccaugcccgaggagacccagacccaggaccagcccauggaggaggaggagguggagacguucgccuuccaggccgagaucgcgcagcugaugagccucaucaucaacaccuucuacuccaacaaggagaucuuccugcgcgagcugaucagcaacuccagcgacgcccucgacaagauccgguacgagucccugaccgaccccagcaagcuggacuccggcaaggagcuccacaucaaccugauccccaacaagcaggaccgcacccugacgaucgucgacaccgggaucggcaugaccaaggccgaccucaucaacaaccuggggaccaucgccaagagcggcacgaaggccuucauggaggcgcugcaggccggggccgacaucuccaugaucggccaguucggcgugggguucuacagcgccuaccucguggcggagaaggucaccgugaucaccaagcacaacgacgacgagcaguacgccugggaguccagcgccggcggguccuucaccgugcggacggacaccggcgagcccauggggcgcggcaccaaggucauccugcaccugaaggaggaccagaccgaguaccucgaggagcggcgcaucaaggagaucgugaagaagcacagccaguucaucggcuacccgaucacgcuguucguggagaaggagcgggacaaggaggucuccgacgacgaggccgaggagaaggaggacaaggaggaggagaaggagaaggaggagaaggagagcgaggacaagcccgagaucgaggacgugggguccgacgaggaggaggagaagaaggacggcgacaagaagaagaagaagaagaucaaggagaaguacaucgaccaggaggagcugaacaagaccaagcccaucuggacccgcaaccccgacgacaucaccaacgaggaguacggggaguucuacaagagccucacgaacgacugggaggaccaccuggccgugaagcacuucuccgucgagggccagcuggaguuccgggcgcuccuguucgugccgcgccgggcccccuucgaccuguucgagaaccgcaagaagaagaacaacaucaagcucuacgugcggcgcgucuucaucauggacaacugcgaggagcugauccccgaguaccugaacuucauccggggcgugguggacagcgaggaccucccccugaacaucagccgcgagaugcugcagcaguccaagauccucaaggucauccggaagaaccuggugaagaagugccuggagcuguucaccgagcucgccgaggacaaggagaacuacaagaaguucuacgagcaguucagcaagaacaucaagcuggggauccacgaggacucccagaaccgcaagaagcucagcgagcugcugcgguacuacaccuccgccagcggcgacgagauggugucccucaaggacuacugcacccgcaugaaggagaaccagaagcacaucuacuacaucacgggggagaccaaggaccaggucgccaacagcgcguucguggagcggcugcgcaagcacggccuggaggugaucuacaugaucgagccgaucgacgaguacugcguccagcagcucaaggaguucgaggggaagacccugguguccgucaccaaggagggccuggagcuccccgaggacgaggaggagaagaagaagcaggaggagaagaagacgaaguucgagaaccugugcaagaucaugaaggacauccuggagaagaagguggagaagguggucgugagcaaccgccucgugaccucccccugcugcaucgucaccagcaccuacggcuggacggccaacauggagcggaucaugaaggcccaggcccugcgcgacaacuccaccaugggguacauggccgcgaagaagcaccuggagaucaaccccgaccacagcaucaucgagacccugcggcagaaggccgaggccgacaagaacgacaaguccgugaaggaccucgugauccugcuguacgagaccgcccuccugagcuccggcuucagccuggaggacccgcagacgcacgccaaccgcaucuaccggaugaucaagcucgggcugggcaucgacgaggacgaccccaccgcggacgacaccuccgccgccgucaccgaggagaugccgccccuggagggggacgacgacaccagccgcauggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6383 - RNA, 615 nt, Artificial Sequence
  mRNA product Design5 comprising derived and/or modified sequence from Homo sapiens__NG_005218__HsHSP90AA3P (opt1)
gggagagucccgcagucggcguccagcggcucugcuuguucgugugugugucguugcaggccuuauucaagcuuaccauggacagcuccaagcuggacagcggcaaggggcuccacaucaaccuggugcccaacaagcagaaccagacccugaccaucgucgacacgcgcaucggcaugaccaagaccgaccucaucaacaaccuggggaccgugacgaaguccggcaccaaggccuucauggaggcccugcaggcggacgccgacaucagcaugaucgggcacuucggcgugggcuucuacuccgccuaccucgucgccaagaaggugaccgugaucagcaagcacaacaacgacgagcaguacaccugggaguccagcgccgggggcuccuucacgguccggaccgacgagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6384 - RNA, 2451 nt, Artificial Sequence
  mRNA product Design5 comprising derived and/or modified sequence from Homo sapiens__NP_031381.2__HsHSP90AB1 (opt1)
gggagagucccgcagucggcguccagcggcucugcuuguucgugugugugucguugcaggccuuauucaagcuuaccaugcccgaggaggugcaccacggcgaggaggaggucgagaccuucgccuuccaggccgagaucgcgcagcugaugagccucaucaucaacaccuucuacuccaacaaggagaucuuccugcgcgagcugaucagcaacgccuccgacgcccucgacaagauccgguacgagagccugacggacccguccaagcuggacagcgggaaggagcucaagaucgacaucauccccaacccccaggagcgcacccugacccugguggacaccggcaucgggaugacgaaggccgaccucaucaacaaccugggcaccaucgccaaguccgggaccaaggcguucauggaggcccugcaggccggcgccgacaucagcaugaucggccaguucggggugggcuucuacuccgcguaccucgucgccgagaaggugguggucaucaccaagcacaacgacgacgagcaguacgccugggagagcuccgccgggggcagcuucacggugcgggccgaccacggggagcccaucggccgcggcaccaaggugauccugcaccugaaggaggaccagaccgaguaccucgaggagcggcgcgucaaggagguggugaagaagcacucccaguucaucggguacccgaucacccuguaccuggagaaggagcgggagaaggagaucagcgacgacgaggcggaggaggagaagggcgagaaggaggaggaggacaaggacgacgaggagaagcccaagaucgaggacgucggguccgacgaggaggacgacagcggcaaggacaagaagaagaagacgaagaagaucaaggagaaguacaucgaccaggaggagcucaacaagaccaagcccaucuggacccgcaaccccgacgacaucacccaggaggaguacggcgaguucuacaagucccugacgaacgacugggaggaccaccuggccgugaagcacuucagcguggaggggcagcucgaguuccgggcccugcuguucaucccgcgccgggcccccuucgaccucuucgagaacaagaagaagaagaacaacaucaagcuguacguccgccggguguucaucauggacuccugcgacgagcugauccccgaguaccucaacuucauccgcggcguggucgacagcgaggaccugccccugaacaucagccgggagaugcuccagcaguccaagauccugaaggugauccgcaagaacaucgugaagaagugccuggagcuguucagcgagcucgccgaggacaaggagaacuacaagaaguucuacgaggcguucuccaagaaccugaagcucgggauccacgaggacagcaccaaccggcgccggcuguccgagcugcuccgcuaccacaccagccaguccggcgacgagaugaccagccuguccgaguacgucagccggaugaaggagacgcagaaguccaucuacuacaucaccggggagagcaaggagcaggucgccaacuccgccuucguggagcgcgugcgcaagcggggcuucgagguggucuacaugaccgagccgaucgacgaguacugcgugcagcagcugaaggaguucgacggcaagagccucguguccgucaccaaggaggggcuggagcugcccgaggacgaggaggagaagaagaagauggaggagagcaaggccaaguucgagaaccucugcaagcugaugaaggagauccuggacaagaagguggagaaggugacgaucuccaaccgccucgucagcucccccugcugcaucgugaccagcaccuacggcuggaccgccaacauggagcggaucaugaaggcgcaggcccugcgcgacaacagcacgaugggguacaugauggccaagaagcaccuggagaucaaccccgaccacccgaucguggagacccugcggcagaaggccgaggccgacaagaacgacaaggcggucaaggaccucguggugcugcuguucgagaccgcccuccuguccagcggcuucucccuggaggacccccagacccacagcaaccgcaucuaccggaugaucaagcucgggcugggcaucgacgaggacgaggucgccgccgaggagcccaacgcggccgugcccgacgagaucccgccccuggagggcgacgaggacgccucccgcauggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6385 - RNA, 2688 nt, Artificial Sequence
  mRNA product Design5 comprising derived and/or modified sequence from Homo sapiens__NP_003290.1__HsHSP90B1 (opt1)
gggagagucccgcagucggcguccagcggcucugcuuguucgugugugugucguugcaggccuuauucaagcuuaccaugcgcgcccugugggugcucggccugugcugcguccugcucaccuucgggagcgugcgggccgacgacgagguggacgucgacggcaccguggaggaggaccuggggaagucccgcgagggcagccggacggacgacgaggugguccagcgcgaggaggaggcgauccagcuggacgggcucaacgccucccagauccgggagcugcgcgagaaguccgagaaguucgccuuccaggccgaggugaaccggaugaugaagcugaucaucaacagccucuacaagaacaaggagaucuuccugcgcgagcugaucagcaacgccuccgacgcgcucgacaagauccggcugaucagccugaccgacgagaacgcccucuccggcaacgaggagcugaccgugaagaucaagugcgacaaggagaagaaccugcuccacgucaccgacacgggcguggggaugacccgcgaggagcuggugaagaaccugggcaccaucgccaagagcgggaccuccgaguuccucaacaagaugacggaggcccaggaggacggccagagcaccuccgagcugaucgggcaguucggcgucggcuucuacagcgcguuccugguggccgacaaggugaucgucaccuccaagcacaacaacgacacccagcacaucugggagagcgacuccaacgaguucagcgugaucgccgacccccgggggaacacgcucggccgcgggaccaccaucacccuggugcugaaggaggaggccuccgacuaccucgagcuggacacgaucaagaaccuggucaagaaguacagccaguucaucaacuucccgaucuacguguggagcuccaagaccgagaccguggaggagcccauggaggaggaggaggccgcgaaggaggagaaggaggagagcgacgacgaggccgccgucgaggaggaggaggaggagaagaagcccaagaccaagaagguggagaagacggugugggacugggagcucaugaacgacaucaagcccaucuggcagcggccguccaaggaggucgaggaggacgaguacaaggccuucuacaagagcuucuccaaggagagcgacgaccccauggccuacauccacuucaccgcggagggcgaggugaccuucaaguccauccuguucguccccaccagcgcgccccgcggccuguucgacgaguacggguccaagaaguccgacuacaucaagcucuacgugcggcgcguguucaucacggacgacuuccacgacaugaugccgaaguaccugaacuucgucaagggcgugguggacagcgacgaccugccccucaacgucagccgggagacccugcagcagcacaagcugcucaaggugauccgcaagaagcuggugcggaagacccuggacaugaucaagaagaucgccgacgacaaguacaacgacaccuucuggaaggaguucgggacgaacaucaagcucggcgucaucgaggaccacuccaaccgcacccggcuggccaagcugcuccgcuuccagagcucccaccaccccaccgacaucaccagccuggaccaguacguggagcgcaugaaggagaagcaggacaagaucuacuucauggccggguccagccggaaggaggccgaguccagccccuucguggagcgccugcucaagaagggcuacgaggucaucuaccugacggagccgguggacgaguacugcauccaggcccugcccgaguucgacggcaagcgguuccagaacguggccaaggagggggucaaguucgacgagagcgagaagaccaaggagucccgcgaggccguggagaaggaguucgagccccugcucaacuggaugaaggacaaggcccugaaggacaagaucgagaaggcgguggucagccagcggcugaccgagucccccugcgcccucguggccagccaguacggcugguccgggaacauggagcgcaucaugaaggcccaggcguaccagaccggcaaggacaucagcacgaacuacuacgccucccagaagaagaccuucgagaucaacccgcggcacccccugauccgcgacaugcugcggcgcaucaaggaggacgaggacgacaagaccgugcucgaccuggccgucgugcuguucgagaccgccacccuccggagcggguaccugcugcccgacacgaaggccuacggcgaccgcaucgagcggaugcuccgccugucccugaacaucgaccccgacgcgaagguggaggaggagccggaggaggagcccgaggagaccgccgaggacaccaccgaggacacggagcaggacgaggacgaggagauggacgucggcaccgacgaggaggaggagaccgccaaggagagcaccgccgagaaggacgagcucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6386 - RNA, 2391 nt, Artificial Sequence
  mRNA product Design5 comprising derived and/or modified sequence from Homo sapiens__NP_057376.2__HsTRAP1 (opt1)
gggagagucccgcagucggcguccagcggcucugcuuguucgugugugugucguugcaggccuuauucaagcuuaccauggcccgcgagcugcgggcccuccugcuguggggccgccggcuccgcccccugcugcgggcgccggcccucgccgccgugcccgggggcaagcccauccugugcccccgccggaccaccgcccagcuggggccgcgccggaaccccgcguggagccuccaggccggccgccuguucuccacgcagaccgccgaggacaaggaggagccccugcacagcaucaucuccagcaccgaguccguccaggggagcaccuccaagcacgaguuccaggccgagacgaagaagcuccuggacaucguggcgcggagccuguacuccgagaaggagguguucauccgcgagcucaucagcaacgccuccgacgcccuggagaagcugcggcacaagcucgucagcgacggccaggcccugcccgagauggagauccaccuccagaccaacgccgagaagggcaccaucaccauccaggacacggggaucggcaugacccaggaggagcugguguccaaccuggggaccaucgcgcgcagcggcuccaaggccuuccuggacgcccuccagaaccaggccgaggccagcuccaagaucaucgggcaguucggcgugggcuucuacagcgcguucauggucgccgaccggguggagguguacucccgcagcgccgccccggggagccugggcuaccaguggcuguccgacgggagcggcgucuucgagaucgccgaggcguccggcgugcggaccgggacgaagaucaucauccaccucaagagcgacugcaaggaguucuccagcgaggcccgcgugcgggacgucgugaccaaguacuccaacuucgugagcuucccccuguaccugaacggccgccggaugaacacccuccaggccaucuggaugauggaccccaaggacguccgcgaguggcagcacgaggaguucuaccgcuacguggcccaggcccacgacaagccccgguacacccugcacuacaagacggacgcgccgcugaacauccgcuccaucuucuacgugcccgacaugaagcccagcauguucgacgucucccgggagcucgggagcuccguggcccuguacagccgcaaggugcugauccagaccaaggccaccgacauccuccccaaguggcugcgguucauccgcggcgucguggacuccgaggacaucccgcugaaccucagccgggagcugcugcaggaguccgcccucauccgcaagcugcgggacgugcugcagcagcgccucaucaaguucuucaucgaccagagcaagaaggacgcggagaaguacgccaaguucuucgaggacuacgggcuguucaugcgggagggcaucgucaccgccacggagcaggaggugaaggaggacaucgccaagcugcuccgcuacgaguccagcgcccugcccagcggccagcugaccucccugagcgaguacgcgucccggaugcgcgccgggacccggaacaucuacuaccucugcgcccccaaccgccaccuggccgagcacagccccuacuacgaggccaugaagaagaaggacaccgagguccuguucugcuucgagcaguucgacgagcucacgcugcugcaccuccgggaguucgacaagaagaagcugaucuccguggagaccgacaucguggucgaccacuacaaggaggagaaguucgaggaccgcagcccggcggccgagugccuguccgagaaggagaccgaggagcucauggccuggaugcggaacgugcugggcagccgcgugaccaacgucaaggugacgcugcgccucgacacccaccccgccauggugaccguccuggagaugggggccgcgcggcacuuccugcgcaugcagcagcucgccaagacccaggaggagcgggcccagcugcugcagcccacgcucgagaucaacccccgccacgcccugaucaagaagcugaaccagcuccgggcguccgagccgggccuggcccagcugcucguggaccagaucuacgagaacgccaugaucgccgccgggcugguggacgacccccgcgcgauggucggccggcugaacgagcuccuggugaaggcccuggagcgccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6387 - RNA, 738 nt, Artificial Sequence
  mRNA product Design5 comprising derived and/or modified sequence from Homo sapiens__NP_000609.1__HsIGF1 (opt1)
gggagagucccgcagucggcguccagcggcucugcuuguucgugugugugucguugcaggccuuauucaagcuuaccaugggcaagaucagcucccugcccacccagcuguucaagugcugcuucugcgacuuccucaaggugaagaugcacaccaugagcuccagccaccuguucuaccucgcccugugccugcucacguucaccuccagcgccaccgcggggccggagacccugugcggcgccgagcuggucgacgcccuccaguucgugugcggggaccgcggcuucuacuucaacaagcccacgggguacggcuccagcucccggcgcgcgccccagaccggcaucguggacgagugcugcuuccggagcugcgaccugcgccggcuggagauguacugcgcgccccucaagccggccaaguccgcccgcagcguccgggcccagcgccacaccgacaugcccaagacccagaaggaggugcaccugaagaacgccucccgggggagcgccggcaacaagaacuaccgcaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6388 - RNA, 819 nt, Artificial Sequence
  mRNA product Design5 comprising derived and/or modified sequence from Homo sapiens__NP_000603.1__HsIGF2 (opt1)
gggagagucccgcagucggcguccagcggcucugcuuguucgugugugugucguugcaggccuuauucaagcuuaccaugggcauccccauggggaaguccaugcuggugcuccugaccuuccuggccuucgccagcugcugcaucgcggccuaccgcccgagcgagacccucugcggcggggagcuggucgacacgcugcaguucgugugcggcgaccggggguucuacuucucccgccccgccagccgggugucccgccggagccgcggcaucgucgaggagugcugcuuccgguccugcgaccucgcccugcuggagaccuacugcgccacccccgccaagagcgagcgcgacguguccacgcccccgaccgugcuccccgacaacuucccccgguaccccgucggcaaguucuuccaguacgacaccuggaagcagagcacccagcgccugcggcgcgggcugccggcgcuccugcgggcccgccggggccacgugcuggccaaggagcucgaggcguuccgcgaggccaagcggcaccgcccccugaucgcccugcccacccaggaccccgcccacgggggcgccccgcccgagauggcguccaaccggaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6389 - RNA, 915 nt, Artificial Sequence
  mRNA product Design5 comprising derived and/or modified sequence from Homo sapiens__NP_000591.1__HsIL6 (opt1)
gggagagucccgcagucggcguccagcggcucugcuuguucgugugugugucguugcaggccuuauucaagcuuaccaugaacagcuucuccaccagcgccuucggccccguggccuucucccuggggcuccugcugguccucccggcggccuuccccgcccccgugcccccgggcgaggacagcaaggacguggccgcgccccaccgccagccccugaccuccagcgagcggaucgacaagcagauccgcuacauccuggacgggaucuccgcccuccggaaggagacgugcaacaagagcaacaugugcgaguccagcaaggaggcccuggccgagaacaaccugaaccuccccaagauggccgagaaggacggcugcuuccaguccggguucaacgaggagaccugccuggucaagaucaucaccggccugcucgaguucgagguguaccuggaguaccugcagaaccgcuucgagagcuccgaggagcaggcgcgggccgugcagaugagcaccaagguccucauccaguuccugcagaagaaggccaagaaccuggacgccaucacgaccccggaccccaccaccaacgccucccuccugacgaagcugcaggcgcagaaccaguggcuccaggacaugaccacccaccugauccugcgcagcuucaaggaguuccuccaguccagccugcgggcccugcgccagaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6390 - RNA, 1557 nt, Artificial Sequence
  mRNA product Design5 comprising derived and/or modified sequence from Homo sapiens__NP_002183.1__HsINHBA (opt1)
gggagagucccgcagucggcguccagcggcucugcuuguucgugugugugucguugcaggccuuauucaagcuuaccaugccccugcucuggcugcgcggcuuccugcucgccagcugcuggaucaucgugcgguccagcccgacccccggguccgagggccacagcgccgcgcccgacugccccuccugcgcccuggccgcccugccgaaggacguccccaacagccagcccgagaugguggaggccgugaagaagcacauccucaacaugcugcaccugaagaagcgccccgacgucacccagccggugcccaaggcggcccuccugaacgccauccggaagcugcacguggggaaggucggcgagaacggguacguggagaucgaggacgacaucggccgccgggccgagaugaacgagcucauggagcagacguccgagaucaucaccuucgcggagagcggcaccgcccgcaagacccugcacuucgagaucuccaaggaggggagcgaccuguccguggucgagcgggccgagguguggcuguuccucaaggugcccaaggccaaccgcacgcggaccaaggucaccauccgccuguuccagcagcagaagcacccccagggcagccucgacaccggggaggaggccgaggaggugggccugaagggggagcgguccgagcugcuccugagcgagaagguggucgacgcgcgcaaguccacguggcacguguucccggugagcuccagcauccagcggcugcucgaccagggcaaguccagccuggacguccgcaucgccugcgagcagugccaggagagcggcgccucccuggugcuccuggggaagaagaagaagaaggaggaggagggcgaggggaagaagaagggcggcggggagggcggggccggcgccgacgaggagaaggagcagagccaccggcccuuccugaugcuccaggcgcgccaguccgaggaccacccccaccggcgccggcgccgggggcuggagugcgacggcaaggugaacaucugcugcaagaagcaguucuucgucagcuucaaggacaucggcuggaacgacuggaucaucgcccccuccggguaccacgccaacuacugcgagggcgagugcccgagccacaucgccgggaccuccggcagcucccugagcuuccacuccaccgugaucaaccacuaccgcaugcgcgggcacagccccuucgccaaccucaaguccugcugcgugcccaccaagcugcggcccaugagcaugcuguacuacgacgacggccagaacaucaucaagaaggacauccagaacaugaucgucgaggagugcggcugcuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6391 - RNA, 1500 nt, Artificial Sequence
  mRNA product Design5 comprising derived and/or modified sequence from Homo sapiens__NP_002184.2__HsINHBB (opt1)
gggagagucccgcagucggcguccagcggcucugcuuguucgugugugugucguugcaggccuuauucaagcuuaccauggacggccugcccgggcgcgcccucggcgccgcgugccugcugcuccuggccgccggguggcugggcccggaggccugggggagccccaccccgcccccgacccccgccgcgcccccgcccccgcccccgcccggcucccccggcgggagccaggacacgugcaccuccugcggcggguuccggcgccccgaggagcucggccggguggacggggacuuccuggaggccgucaagcgccacauccugagccggcuccagaugcgcggccggcccaacaucacccacgccgugcccaaggccgcgauggugaccgcccugcgcaagcugcacgccggcaagguccgggaggacgggcgcguggagaucccccaccucgacggccacgccucccccggggccgacggccaggagcgggugagcgagaucaucuccuucgcggagacggacggccuggccagcucccgcguccggcuguacuucuucaucagcaacgaggggaaccagaaccucuucguggugcaggccucccuguggcuguaccucaagcugcugcccuacguccucgagaagggcagccgccggaaggugcgcgugaaggucuacuuccaggagcaggggcacggcgaccgguggaacaugguggagaagcgcguggaccugaagcgguccggguggcacaccuucccccugaccgaggccauccaggcccucuucgagcgcggcgagcggcgccugaaccuggacguccagugcgacagcugccaggagcucgcgguggugcccgucuucguggaccccggcgaggagucccaccgccccuucguggucgugcaggcccggcugggggacagccgccaccggauccgcaagcggggccuggagugcgacgggcgcaccaaccucugcugccggcagcaguucuucaucgacuuccgccugaucggcuggaacgacuggaucaucgccccgacgggguacuacggcaacuacugcgagggcuccugccccgccuaccuggccggggugcccggcagcgcguccagcuuccacaccgccgucgugaaccaguaccggaugcgcgggcucaaccccggcaccgucaacagcugcugcaucccgaccaagcuguccacgaugagcaugcuguacuucgacgacgaguacaacaucgugaagcgggacgugcccaacaugaucgucgaggagugcgggugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6392 - RNA, 3735 nt, Artificial Sequence
  mRNA product Design5 comprising derived and/or modified sequence from Homo sapiens__NP_000623.2__HsITGAM (opt1)
gggagagucccgcagucggcguccagcggcucugcuuguucgugugugugucguugcaggccuuauucaagcuuaccauggcccugcgcgugcuccugcugaccgcccucacccugugccacggcuucaaccuggacacggagaacgcgaugaccuuccaggagaacgcccggggguucggccagagcgucgugcagcuccaggggucccgcguggucgugggcgccccccaggagaucguggccgccaaccagcgggggagccuguaccagugcgacuacuccaccggcagcugcgagccgauccgccugcagguccccguggaggcggugaacaugucccucggccugagccuggccgccaccacgucccccccccagcuccuggccugcgggccgaccguccaccagaccugcagcgagaacaccuacgugaagggccugugcuuccucuucggguccaaccugcggcagcagccccagaaguuccccgaggcgcugcgcggcugcccccaggaggacagcgacaucgccuuccucaucgacggguccggcagcaucaucccgcacgacuuccggcgcaugaaggaguucguguccacggucauggagcagcugaagaaguccaagacccuguucucccucaugcaguacagcgaggaguuccggauccacuucaccuucaaggaguuccagaacaaccccaacccccgcucccuggugaagcccaucacccagcugcucggccggacgcacaccgccaccgggauccgcaaggugguccgggagcuguucaacaucaccaacggcgcccgcaagaacgccuucaagauccugguggugaucacggacggggagaaguucggcgacccgcucggcuacgaggacgucauccccgaggcggaccgggagggggugauccgcuacgugaucggcgucggggacgccuuccggagcgagaagucccgccaggagcugaacaccaucgccagcaagcccccccgggaccacguguuccaggugaacaacuucgaggcccugaagaccauccagaaccagcuccgcgagaagaucuucgccaucgagggcacccagacggggagcuccagcuccuucgagcacgagaugagccaggagggcuucuccgcggccaucaccagcaacggcccgcugcuguccaccgucgggagcuacgacugggccggcgggguguuccucuacaccuccaaggagaaguccacguucaucaacaugacccgggucgacuccgacaugaacgacgccuaccugggcuacgccgcggccaucauccugcgcaaccgcgugcagagccucgugcugggggccccccgguaccagcacaucggccuggucgccauguuccgccagaacaccggcaugugggaguccaacgccaacgugaaggggacccagaucggcgcguacuucggggccagccucugcuccguggacgucgacagcaacggcuccacggaccuggugcugaucggggccccccacuacuacgagcagacccggggcggccaggugagcgucugcccccucccgcgcgggcgggcccgcuggcagugcgacgcggugcuguacggcgagcaggggcagcccuggggccgguucggcgccgcccugaccgugcucggggacgucaacggcgacaagcugaccgacguggccaucggggcccccggcgaggaggacaaccgcggggcgguguaccuguuccacggcacguccggcagcgggaucagccccucccacagccagcggaucgccggcuccaagcucagcccgcgccugcaguacuucgggcagucccugagcggcgggcaggaccugaccauggacggccucgucgaccugaccgugggcgcccaggggcacgugcugcuccugcggucccagcccguccugcgcgugaaggccaucauggaguucaacccccgggagguggcccgcaacgucuucgagugcaacgaccagguggugaagggcaaggaggcgggggagguccgggugugccuccacgugcagaaguccacccgcgaccggcugcgcgagggccagauccaguccgucgugacguacgaccuggcccucgacagcgggcggccccacucccgcgccguguucaacgagaccaagaacagcacccgccggcagacccagguccugggccugacccagacgugcgagacccucaagcugcagcugccgaacugcaucgaggaccccgugucccccaucgugcuccgccugaacuucagccuggucggcaccccgcucuccgccuucgggaaccugcggcccgugcuggccgaggacgcgcagcgccucuucaccgcccuguuccccuucgagaagaacugcggcaacgacaacaucugccaggacgaccugagcaucacguucuccuucaugagccucgacugccugguggucgggggcccccgggaguucaacgugaccgugaccguccgcaacgacggggaggacagcuaccggacccaggugacguucuucuucccgcuggaccucuccuaccgcaaggugagcacccugcagaaccagcggucccagcgcagcuggcggcuggccugcgaguccgccagcuccaccgaggucagcggcgcgcucaaguccaccagcugcuccaucaaccaccccaucuuccccgagaacagcgaggugacguucaacaucaccuucgacguggacuccaaggccagccugggcaacaagcugcuccugaaggccaacgucaccuccgagaacaacaugccccgcaccaacaagacggaguuccagcuggagcucccggugaaguacgccguguacauggucgugaccagccacgggguguccaccaaguaccugaacuucaccgccagcgagaacacgucccgggucaugcagcaccaguaccaggugagcaaccugggccagcgcagccuccccaucucccuggucuuccuggugcccgugcggcucaaccagaccgucaucugggaccgcccccaggugaccuucagcgagaaccuguccagcacaugccacacgaaggagcggcugccgucccacagcgacuuccucgcggagcugcgcaaggcccccguggucaacugcuccaucgccgugugccagcggauccagugcgacauccccuucuucgggauccaggaggaguucaacgccacccugaagggcaaccucagcuucgacugguacaucaagaccucccacaaccaccuccugaucgugagcaccgccgagauccucuucaacgacuccgucuucacgcugcugcccggccagggggcguucgugcgcagccagaccgagaccaagguggagccguucgagguccccaacccccucccccugaucgugggcuccagcguggggggccugcuccugcuggcccucaucaccgccgcccuguacaagcugggguucuucaagcggcaguacaaggacaugauguccgagggcggcccgcccggggccgagccccagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6393 - RNA, 1680 nt, Artificial Sequence
  mRNA product Design5 comprising derived and/or modified sequence from Homo sapiens__NP_002415.1__HsMMP8 (opt1)
gggagagucccgcagucggcguccagcggcucugcuuguucgugugugugucguugcaggccuuauucaagcuuaccauguucagccugaagacccuccccuuccugcugcuccugcacgugcagaucuccaaggccuucccggucagcuccaaggagaagaacaccaagacggugcaggacuaccuggagaaguucuaccagcuccccagcaaccaguaccaguccacccgcaagaacggcaccaacgugaucgucgagaagcugaaggagaugcagcgguucuucgggcugaacgugaccggcaagcccaacgaggagacgcucgacaugaugaagaagccccgcugcggggugccggacagcggcggguucaugcugacccccggcaaccccaagugggagcggaccaaccugaccuaccgcauccggaacuacacgccccagcucuccgaggccgaggucgagcgcgcgaucaaggacgccuucgagcuguggagcguggccuccccgcugaucuucacccggaucagccagggcgaggccgacaucaacaucgccuucuaccagcgcgaccacggggacaacucccccuucgacggccccaacgggauccucgcgcacgccuuccagcccggccaggggaucggcggcgacgcccacuucgacgccgaggagaccuggaccaacacgagcgcgaacuacaaccuguuccugguggccgcccacgaguucgggcacucccucggccuggcccacagcuccgacccgggggcccugauguaccccaacuacgcguuccgggagaccagcaacuacucccucccccaggacgacaucgacggcauccaggccaucuacggccugagcuccaaccccauccagccgaccgggcccagcacccccaagcccugcgacccgagccugacguucgacgccaucaccacccuccgcggcgagauccuguucuucaaggaccgguacuucuggcgccggcacccccagcugcagcgcgucgagaugaacuucaucucccucuucuggcccagccugcccaccgggauccaggccgccuacgaggacuucgaccgggaccugaucuuccucuucaagggcaaccaguacugggcgcuguccggguacgacauccugcagggcuacccgaaggacaucagcaacuacggcuuccccuccagcgugcaggccaucgacgccgccguguucuaccgcuccaagacguacuucuucgucaacgaccaguucuggcgguacgacaaccagcgccaguucauggagcccggguaccccaagagcaucuccggcgccuucccggggaucgagagcaagguggacgcgguguuccagcaggagcacuucuuccacgucuucuccggcccccgguacuacgccuucgaccucaucgcccagcgcgugacccggguggcccgcgggaacaaguggcugaacugccgcuacggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6394 - RNA, 2400 nt, Artificial Sequence
  mRNA product Design5 comprising derived and/or modified sequence from Homo sapiens__NP_004985.2__HsMMP9 (opt1)
gggagagucccgcagucggcguccagcggcucugcuuguucgugugugugucguugcaggccuuauucaagcuuaccaugagccuguggcagccccucgugcugguccugcucgugcugggcugcugcuucgccgccccgcgccagcggcaguccacccugguccucuuccccggggaccugcgcaccaaccugacggaccggcagcucgcggaggaguaccuguaccgcuacggcuacacccggguggccgagaugcgcggggagagcaagucccugggccccgcccuccugcugcuccagaagcagcugagccugcccgagaccggggagcucgacuccgccacccugaaggccaugcggacgccgcgcugcggcgugcccgaccugggccgguuccagaccuucgagggggaccucaaguggcaccaccacaacaucaccuacuggauccagaacuacagcgaggaccugccccgcgcggugaucgacgacgccuucgcccgggccuucgcgcugugguccgccgucacgccccucaccuucacccgcguguacagccgggacgccgacaucgugauccaguucggcgucgccgagcacggggacggcuacccguucgacgggaaggacggccugcuggcccacgcguucccgcccggccccgggauccagggcgacgcccacuucgacgacgacgagcucuggucccuggggaagggcguggugguccccacccgcuucggcaacgccgacggggccgccugccacuuccccuucaucuucgagggccggagcuacuccgcgugcaccacggacgggcgcagcgacggccugcccuggugcuccaccaccgccaacuacgacaccgacgaccgguucggguucugccccagcgagcgccucuacacgcaggacggcaacgccgacggcaagccgugccaguuccccuucaucuuccaggggcaguccuacagcgccugcaccaccgacggccgguccgacggguaccgcuggugcgccaccacggcgaacuacgaccgggacaagcuguucggcuucugccccacccgcgccgacagcaccgugaugggcggcaacuccgccggcgagcugugcguguuccccuucaccuuccucgggaaggaguacagcacgugcaccagcgagggccgcggggacggccggcuguggugcgccaccaccuccaacuucgacagcgacaagaaguggggguucugcccggaccagggcuacucccuguuccucgucgccgcgcacgaguucggccacgcccuggggcuggaccacagcuccgugcccgaggcccucauguaccccauguaccgcuucacggaggggcccccgcugcacaaggacgacgugaacgggauccggcaccuguacggcccccgccccgagcccgagccgcggccgcccaccaccaccacgccccagcccaccgccccgcccaccgucugccccaccggcccgcccacggugcaccccagcgagcgccccaccgcggggcccaccggcccgcccuccgccgggcccaccggcccgcccaccgccgggcccagcacggccaccaccgugccccucucccccgucgacgacgccugcaacgugaacaucuucgacgcgaucgccgagaucggcaaccagcuguaccuguucaaggacggcaaguacuggcgguucagcgaggggcgcggcucccggccccaggggcccuuccucaucgccgacaaguggccggcccugccccgcaagcuggacagcguguucgaggagcggcucuccaagaagcuguucuucuucagcggccgccaggucuggguguacaccggggccuccguccugggcccccggcgccuggacaagcucggccugggggcggacguggcccaggugacgggcgcccugcggagcgggcgcggcaagaugcuccuguucuccgggcggcgccuguggcgguucgacgucaaggcccagaugguggacccccgcagcgccuccgagguggaccgcauguucccgggcgucccccucgacacccacgacguguuccaguaccgggagaaggcguacuucugccaggaccgcuucuacuggcgggugagcagccgcuccgagcugaaccaggucgaccaggugggcuacgugaccuacgacauccugcagugccccgaggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6395 - RNA, 1692 nt, Artificial Sequence
  mRNA product Design5 comprising derived and/or modified sequence from Homo sapiens__NP_002418.1__HsMMP13 (opt1)
gggagagucccgcagucggcguccagcggcucugcuuguucgugugugugucguugcaggccuuauucaagcuuaccaugcaccccggcgugcuggccgccuuccucuuccugagcuggacccacugccgcgcgcugccgcuccccuccgggggcgacgaggacgaccugagcgaggaggaccugcaguucgccgagcgguaccuccgcuccuacuaccaccccaccaaccuggccgggauccugaaggagaacgccgccagcuccaugacggagcggcuccgcgagaugcagagcuucuucggccuggaggucaccgggaagcuggacgacaacacccucgacgugaugaagaagccccggugcggcgugccggacgucggcgaguacaacguguucccccgcacccugaagugguccaagaugaaccugacguaccggaucgugaacuacacccccgacaugacccacagcgaggucgagaaggcguucaagaaggccuucaaggugugguccgacgugacgccccucaacuucacccgccugcacgacgggaucgccgacaucaugaucagcuucggcaucaaggagcacggggacuucuacccguucgacggccccuccgggcugcucgcccacgcguucccgcccggccccaacuacggcggggacgcccacuucgacgacgacgagaccuggaccagcuccagcaagggcuacaaccuguuccuggucgccgcccacgaguucgggcacucccucggccuggaccacagcaaggaccccggcgcccugauguuccccaucuacaccuacacggggaagucccacuucaugcuccccgacgacgacgugcagggcauccagagccuguacgggccgggcgacgaggaccccaaccccaagcaccccaagaccccggacaagugcgaccccucccugagccucgacgcgaucaccagccugcgcggggagaccaugaucuucaaggaccgguucuucuggcggcugcacccccagcaggucgacgccgagcuguuccugacgaaguccuucuggcccgagcugccgaaccgcaucgacgccgccuacgagcaccccagccacgaccucaucuucaucuuccggggccgcaaguucugggcccugaacggcuacgacauccuggagggguaccccaagaagaucuccgagcucggccugcccaaggaggugaagaagaucagcgcggccgugcacuucgaggacaccgggaagacccuccucuucuccggcaaccagguguggcgguacgacgacaccaaccacaucauggacaaggacuacccgcgccugaucgaggaggacuuccccgggaucggcgacaaggucgacgccguguacgagaagaacggcuacaucuacuucuucaacgggcccauccaguucgaguacagcaucugguccaaccggaucgugcgcgucaugccggccaacagcauccuguggugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6396 - RNA, 1344 nt, Artificial Sequence
  mRNA product Design5 comprising derived and/or modified sequence from Homo sapiens__NP_001286.1__HsCCR1 (opt1)
gggagagucccgcagucggcguccagcggcucugcuuguucgugugugugucguugcaggccuuauucaagcuuaccauggagacccccaacaccacggaggacuacgacaccaccaccgaguucgacuacggcgacgccacgccgugccagaaggugaacgagcgcgccuucggggcgcagcugcucccgccccuguacagccuggucuucgugaucggccucguggggaacauccuggucgugcuggugcucguccaguacaagcggcugaagaacaugaccuccaucuaccugcucaaccuggccaucagcgaccuccucuuccuguucacccugcccuucuggaucgacuacaagcucaaggacgacuggguguucggcgacgccaugugcaagauccuguccggguucuacuacaccggccuguacagcgagaucuucuucaucauccuccugacgaucgaccgcuaccuggccaucgugcacgccgucuucgcgcuccgggcccgcaccgugaccuucggcgugaucaccuccaucaucaucugggcccuggccauccuggcgagcaugcccgggcucuacuucuccaagacgcagugggaguucacccaccacacgugcagccugcacuucccccacgagucccugcgggaguggaagcuguuccaggcccugaagcugaaccucuucggccugguccugccccuccuggugaugaucaucugcuacaccgggaucaucaagauccugcuccgccggcccaacgagaagaaguccaaggccgugcgccugaucuucgucaucaugaucaucuucuuccuguucuggaccccguacaaccucaccauccugaucagcguguuccaggacuuccuguucacccacgagugcgagcagagccggcaccucgaccuggccgugcaggucaccgaggugaucgccuacacgcacugcugcgugaaccccgucaucuacgcguucgugggcgagcgcuuccggaaguaccugcgccagcuguuccaccggcgcguggccguccaccucgugaaguggcugcccuuccucuccgucgaccggcuggagcgcgugagcuccaccagccccuccaccggggagcacgagcugagcgccggcuucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6397 - RNA, 912 nt, Artificial Sequence
  mRNA product Design5 comprising derived and/or modified sequence from Homo sapiens__NP_002598.4__HsPDGFA (opt1)
gggagagucccgcagucggcguccagcggcucugcuuguucgugugugugucguugcaggccuuauucaagcuuaccaugcgcacccuggccugccuccugcugcucggcugcggguaccuggcccacgugcuggcggaggaggccgagaucccccgggaggugaucgagcgccucgcccggagccagauccacuccauccgcgaccugcagcggcugcucgagaucgacagcgugggcuccgaggacagccuggacaccucccugcgcgcccacggggugcacgccacgaagcacgucccggagaagcggccccuccccauccgccggaagcgcagcaucgaggaggcggugcccgccgugugcaagacccggaccgucaucuacgagaucccgcgcucccagguggaccccaccagcgccaacuuccugaucuggccgcccugcguggaggucaagcggugcacgggcugcugcaacaccuccagcgugaagugccagcccucccgcgugcaccaccggagcgucaagguggccaagguggaguacguccgcaagaagcccaagcugaaggagguccaggugcggcucgaggagcaccuggagugcgcgugcgccaccaccucccugaaccccgacuaccgcgaggaggacacggggcggccccgcgagagcggcaagaagcggaagcgcaagcgccucaagccgaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6398 - RNA, 1002 nt, Artificial Sequence
  mRNA product Design5 comprising derived and/or modified sequence from Homo sapiens__NP_002599.1__HsPDGFB (opt1)
gggagagucccgcagucggcguccagcggcucugcuuguucgugugugugucguugcaggccuuauucaagcuuaccaugaaccgcugcugggcccuguuccucagccugugcugcuaccugcggcucguguccgccgagggcgaccccaucccggaggagcuguacgagaugcugagcgaccacuccauccgcagcuucgacgaccuccagcggcugcugcacggggaccccggcgaggaggacggggcggagcucgaccugaacaugacccgcucccacagcggcggggagcuggagucccucgcccggggccgccggagccugggcucccugaccaucgccgagcccgccaugaucgccgagugcaagacgcgcaccgaggucuucgagaucagccggcgccucaucgaccggaccaacgcgaacuuccugguguggcccccgugcguggagguccagcgcugcuccgggugcugcaacaaccggaacgugcagugccgccccacccaggugcagcugcggcccguccaggugcgcaagaucgagaucgugcggaagaagcccaucuucaagaaggccacggucacccucgaggaccaccuggccugcaagugcgagaccguggccgcggcccgcccggugacccggagccccggcgggucccaggagcagcgcgccaagacgccccagacccgggucaccauccgcaccgugcgcgugcggcggcccccgaagggcaagcaccgcaaguucaagcacacgcacgacaagaccgcccugaaggagacccucggggccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6399 - RNA, 1314 nt, Artificial Sequence
  mRNA product Design5 comprising derived and/or modified sequence from Homo sapiens__NP_057289.1__HsPDGFC (opt1)
gggagagucccgcagucggcguccagcggcucugcuuguucgugugugugucguugcaggccuuauucaagcuuaccaugagccuguucggccuccugcugcucaccuccgcccuggccgggcagcgccagggcacccaggcggagagcaaccuguccagcaaguuccaguucuccagcaacaaggagcagaacggggugcaggacccccagcacgagcggaucaucacggucuccaccaacggcagcauccacuccccgcgcuucccccacaccuacccccggaacaccgugcucguguggcgccuggucgccguggaggagaacguguggauccagcugacguucgacgagcgguucgggcucgaggaccccgaggacgacaucugcaaguacgacuucgucgagguggaggagccgagcgacggcaccauccugggccgcuggugcggguccggcaccgugcccgggaagcagaucagcaagggcaaccagauccggauccgcuucgucuccgacgaguacuuccccagcgagcccggguucugcauccacuacaacaucgugaugccgcaguucaccgaggccgugucccccagcguccugccgcccuccgcccucccccuggaccugcucaacaacgccaucacggcguucagcacccuggaggaccugauccgguaccucgagcccgagcgcuggcagcuggaccuggaggaccucuaccggcccaccuggcagcugcugggcaaggccuucguguucggccgcaagucccggguggucgaccucaaccugcugaccgaggaggugcgccucuacagcugcacgccccggaacuucagcguguccauccgcgaggagcugaagcggaccgacaccaucuucuggccggggugccugcucgucaagcgcugcggcgggaacugcgccugcugccugcacaacugcaacgagugccagugcgugcccagcaaggugaccaagaaguaccacgagguccugcagcuccggcccaagacgggcgugcgcggccugcacaagucccugaccgacguggcccucgagcaccacgaggagugcgacugcgucugccgggggagcaccggcgggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6400 - RNA, 1371 nt, Artificial Sequence
  mRNA product Design5 comprising derived and/or modified sequence from Homo sapiens__NP_149126.1__HsPDGFD (opt1)
gggagagucccgcagucggcguccagcggcucugcuuguucgugugugugucguugcaggccuuauucaagcuuaccaugcaccgccugaucuucguguacacccucaucugcgccaacuucugcagcugccgggacaccuccgccacgccccagagcgcguccaucaaggcccugcgcaacgccaaccugcggcgcgacgaccucuaccggcgcgacgagaccauccaggucaagggcaacggguacgugcagagcccccgguuccccaacuccuacccccgcaaccugcugcucaccuggcggcugcacagccaggagaacacccgcauccagcugguguucgacaaccaguucggccucgaggaggccgagaacgacaucugccgguacgacuucgucgagguggaggacaucuccgagaccagcaccaucauccgcgggcgguggugcggccacaaggaggugcccccgcgcaucaagucccggaccaaccagaucaagaucaccuucaagagcgacgacuacuucgucgccaagcccggguucaagaucuacuacucccugcuggaggacuuccagcccgcggccgccagcgagacgaacugggaguccgugaccagcuccaucagcggcguguccuacaacagccccuccgucaccgacccgacccucaucgccgacgcgcuggacaagaagaucgccgaguucgacacgguggaggaccugcucaaguacuucaaccccgagagcuggcaggaggaccuggagaacauguaccuggacaccccgcgcuaccggggccgcagcuaccacgaccggaaguccaagguggaccucgaccgccugaacgacgacgccaagcgguacagcugcacgccccgcaacuacuccgucaacauccgcgaggagcugaagcucgccaacgugguguucuucccccggugccugcugguccagcgcugcgggggcaacugcgggugcggcaccgugaacuggcggagcugcacgugcaacuccgggaagaccgugaagaaguaccacgagguccuccaguucgagcccggccacaucaagcgccggggccgcgccaagaccauggcgcugguggacauccagcuggaccaccacgagcggugcgacugcaucugcagcucccgcccgccccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6401 - RNA, 954 nt, Artificial Sequence
  mRNA product Design5 comprising derived and/or modified sequence from Homo sapiens__NP_003946.3__HsSOCS3 (opt1)
gggagagucccgcagucggcguccagcggcucugcuuguucgugugugugucguugcaggccuuauucaagcuuaccauggugacccacagcaaguuccccgccgccggcaugucccgcccgcuggacaccagccuccggcugaagacguucuccagcaaguccgaguaccagcuggucgugaacgcggugcgcaagcuccaggagagcggguucuacugguccgccgucaccggcggggaggccaaccugcugcucagcgccgagcccgccggcaccuuccugauccgggacuccagcgaccagcgccacuucuucacccuguccgugaagacgcagagcgggaccaagaaccuccggauccagugcgagggcggcuccuucagccugcaguccgacccccgcagcacccagcccgugccgcgguucgacugcguccugaagcucgugcaccacuacaugcccccgcccggggcgcccuccuuccccagcccgcccaccgagcccuccagcgaggugcccgagcagcccagcgcccagccccugccgggcuccccgccccgccgggccuacuacaucuacagcgggggcgagaagaucccccugguccucucccgcccccugagcuccaacguggccacgcugcagcaccucugccggaagaccgugaacgggcaccuggacagcuacgagaaggucacccagcugcccggccccauccgcgaguuccucgaccaguacgacgcgccccugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6402 - RNA, 759 nt, Artificial Sequence
  mRNA product Design5 comprising derived and/or modified sequence from Homo sapiens__NP_003227.1__HsTGFA (opt1)
gggagagucccgcagucggcguccagcggcucugcuuguucgugugugugucguugcaggccuuauucaagcuuaccauggugcccagcgccggccagcuggcccucuucgcgcuggggaucguccuggccgccugccaggcccucgagaacuccaccagcccgcuguccgccgacccgcccguggcggccgccguggucagccacuucaacgacugccccgacucccacacccaguucugcuuccacggcacgugccgcuuccuggugcaggaggacaagcccgccugcgugugccacagcggguacgucggcgcgcggugcgagcacgccgaccuccuggccgugguggccgccucccagaagaagcaggcgaucaccgcccuggucguggugagcaucgucgcccucgccgugcugaucaucacgugcgugcugauccacugcugccagguccgcaagcacugcgaguggugccgggcccucaucugccgccacgagaagcccuccgcgcugcugaaggggcggaccgccugcugccacagcgagaccguggugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6403 - RNA, 1449 nt, Artificial Sequence
  mRNA product Design5 comprising derived and/or modified sequence from Homo sapiens__NP_000651.3__HsTGFB1 (opt1)
gggagagucccgcagucggcguccagcggcucugcuuguucgugugugugucguugcaggccuuauucaagcuuaccaugcccccgagcggccugcgccuccugccccugcuccugccccugcucuggcugcuggugcucacccccgggcggccggccgccggccuguccacgugcaagaccaucgacauggagcuggucaagcgcaagcggaucgaggcgauccgcgggcagauccucagcaagcugcggcuggccuccccgcccagccagggcgaggugccgcccgggccccuccccgaggccgugcuggcccuguacaacuccacccgcgaccgggucgccggcgagagcgcggagcccgagcccgagcccgaggccgacuacuacgccaaggaggugacccgcgugcucauggucgagacccacaacgagaucuacgacaaguucaagcaguccacgcacagcaucuacauguucuucaacaccuccgagcugcgggaggccgugcccgagcccgugcugcucagccgcgcggagcugcggcugcuccgccugaagcugaaggucgagcagcacguggagcucuaccagaaguacuccaacaacagcuggcgguaccuguccaaccgccugcucgccccgagcgacucccccgaguggcugagcuucgacgugaccggcgucgugcggcaguggcugucccgcgggggcgagaucgagggguuccggcucagcgcccacugcuccugcgacagccgcgacaacacccuccagguggacaucaacggcuucacgaccgggcggcgcggcgaccuggccaccauccacggcaugaaccggcccuuccugcugcugauggccacgccccucgagcgcgcgcagcaccuccagagcucccgccaccggcgcgcccuggacaccaacuacugcuucagcuccaccgagaagaacugcugcguccggcagcuguacaucgacuuccgcaaggaccugggguggaaguggauccacgagccgaagggcuaccacgccaacuucugccuggggcccugccccuacaucuggagccucgacacccaguacuccaaggugcuggcccuguacaaccagcacaaccccggcgccagcgcggccccgugcugcgugccccaggcccucgagccccugcccaucgucuacuacgugggccggaagccgaagguggagcagcuguccaacaugaucguccgcagcugcaagugcuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6404 - RNA, 1521 nt, Artificial Sequence
  mRNA product Design5 comprising derived and/or modified sequence from Homo sapiens__NP_003229.1__HsTGFB2 (opt1)
gggagagucccgcagucggcguccagcggcucugcuuguucgugugugugucguugcaggccuuauucaagcuuaccaugcacuacugcgugcugagcgccuuccucauccugcaccuggucaccguggcccucucccugagcacgugcuccacccuggacauggaccaguucaugcgcaagcggaucgaggcgauccgcggccagauccucagcaagcugaagcugaccagcccgcccgaggacuaccccgagcccgaggaggugcccccggaggucaucuccaucuacaacuccacccgggaccuccugcaggagaaggccagccgccgggccgccgccugcgagcgcgagcgguccgacgaggaguacuacgcgaaggagguguacaagaucgacaugccgcccuucuuccccagcgagaacgccaucccgcccaccuucuaccgccccuacuuccggaucgugcgcuucgacgucuccgccauggagaagaacgccagcaaccuggugaaggcggaguuccggguguuccgccuccagaaccccaaggcccggguccccgagcagcgcaucgagcuguaccagauccugaaguccaaggaccucacgagccccacccagcgguacaucgacuccaagguggugaagacccgcgccgagggggaguggcugagcuucgacgucaccgacgccgugcacgaguggcugcaccacaaggaccggaaccucggcuucaagaucucccugcacugccccugcugcacguucgugcccagcaacaacuacaucaucccgaacaaguccgaggagcuggaggcccgcuucgcggggaucgacggcaccagcaccuacaccagcggggaccagaagacgaucaaguccacccggaagaagaacagcggcaagacgccccaccuccugcugaugcuccugcccuccuaccgccuggagagccagcagaccaaccggcgcaagaagcgcgcccucgacgccgccuacugcuuccggaacguccaggacaacugcugccugcgcccccuguacaucgacuucaagcgggaccucggcuggaaguggauccacgagccgaagggguacaacgccaacuucugcgcgggcgccugccccuaccugugguccagcgacacccagcacucccgcgugcugagccucuacaacaccaucaaccccgaggccuccgccagccccugcugcgugucccaggaccuggagccgcugaccauccucuacuacaucgggaagacccccaagaucgagcagcugagcaacaugaucgucaaguccugcaagugcagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6405 - RNA, 1515 nt, Artificial Sequence
  mRNA product Design5 comprising derived and/or modified sequence from Homo sapiens__NP_003230.1__HsTGFB3 (opt1)
gggagagucccgcagucggcguccagcggcucugcuuguucgugugugugucguugcaggccuuauucaagcuuaccaugaagaugcaccuccagcgcgcccucguggugcuggcccugcucaacuucgcgaccgugagccugucccugagcacgugcaccacccucgacuucggccacaucaagaagaagcggguggaggccauccgcgggcagauccuguccaagcugcggcucaccagcccgcccgagcccaccgucaugacgcacgugcccuaccaggugcuggcccuguacaacuccacccgcgagcuccuggaggagaugcacggcgagcgggaggaggggugcacccaggagaacaccgagagcgaguacuacgccaaggagauccacaaguucgacaugauccagggccuggccgagcacaacgagcucgcggucugccccaaggggaucacguccaagguguuccgcuucaacgugagcuccgucgagaagaaccggaccaaccuguuccgcgccgaguuccgggugcugcgcgugccgaaccccagcuccaagcggaacgagcagcgcaucgagcuguuccagauccugcggcccgacgagcacaucgccaagcagcgcuacaucggcggcaagaaccugcccacccgggggaccgccgaguggcucagcuucgacgucacggacaccgugcgcgaguggcugcugcggcgcgaguccaaccucggccuggagaucagcauccacugcccgugccacaccuuccagcccaacggggacauccuggagaacauccacgaggugauggagaucaaguucaagggcgucgacaacgaggacgaccacgggcggggcgaccucggccgccugaagaagcagaaggaccaccacaacccccaccugauccucaugaugaucccgccccaccggcuggacaaccccgggcagggcgggcagcgcaagaagcgcgcgcuggacaccaacuacugcuuccggaaccucgaggagaacugcugcgugcgcccccuguacaucgacuuccggcaggaccugggcuggaagugggugcacgagcccaagggcuacuacgccaacuucugcuccgggccgugccccuaccuccgcagcgccgacacgacccacuccaccguccugggccuguacaacacccucaaccccgaggccagcgccucccccugcugcgugccgcaggaccuggagccccugacgauccucuacuacguggggcggacccccaaggucgagcagcugagcaacaugguggucaagagcugcaagugcuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6406 - RNA, 1662 nt, Artificial Sequence
  mRNA product Design5 comprising derived and/or modified sequence from Homo sapiens__NP_001057.1__HsTNFRSF1B (opt1)
gggagagucccgcagucggcguccagcggcucugcuuguucgugugugugucguugcaggccuuauucaagcuuaccauggcccccguggccgucugggcggcccuggccgugggccucgagcugugggccgccgcgcacgcccugccggcccagguggccuucacccccuacgcgcccgagcccgggagcacgugccgccuccgggaguacuacgaccagaccgcccagaugugcugcuccaagugcagcccgggccagcacgccaaggucuucugcaccaagaccuccgacaccgugugcgacagcugcgaggacuccacguacacccagcuguggaacugggugcccgagugccugagcugcgggucccgcugcagcuccgaccaggucgagacccaggccugcacccgggagcagaaccgcaucugcacgugccggcccggcugguacugcgcccucagcaagcaggaggggugccgccugugcgcgccccugcggaagugccgcccgggcuucggcguggcccggcccgggaccgagaccuccgacguggucugcaagcccugcgcccccggcaccuucagcaacacgaccuccagcaccgacaucugccgcccgcaccagaucugcaacgugguggccauccccgggaacgccuccauggacgcggucugcaccagcacgucccccacccggagcauggcccccggcgccgugcaccucccgcagcccguguccacccgcagccagcacacccagcccacgcccgagccgagcaccgcccccuccaccagcuuccugcugcccauggggcccuccccgcccgccgagggcagcaccggcgacuucgcgcuccccgucgggcugaucgugggcgugacggcccuggggcuccugaucaucggcgucgugaacugcgugaucaugacccaggucaagaagaagccccugugccuccagcgggaggccaaggugccgcaccuccccgccgacaaggcccgcggcacccaggggcccgagcagcagcaccuccugaucaccgcgccguccagcuccagcuccagccuggaguccagcgccuccgcccuggaccggcgcgcccccacgcggaaccagccccaggcgcccggcguggaggccagcggggccggcgaggcccgcgccuccaccgggagcuccgacagcuccccgggcggccacgggacccaggucaacgugaccugcaucgucaacgugugcagcagcuccgaccacagcucccagugcagcucccaggcgagcuccacgaugggcgacaccgacagcucccccagcgagucccccaaggacgagcagguccccuucagcaaggaggagugcgccuuccggucccagcuggagaccccggagacccugcuggggagcacggaggagaagccccucccccugggcgugcccgacgccgggaugaagccguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6407 - RNA, 789 nt, Artificial Sequence
  mRNA product Design5 comprising derived and/or modified sequence from Homo sapiens__NP_002623.2__HsPGF (opt1)
gggagagucccgcagucggcguccagcggcucugcuuguucgugugugugucguugcaggccuuauucaagcuuaccaugcccgugaugcgccuguucccgugcuuccuccagcugcuggccggccucgcccugcccgcggucccgccccagcagugggcccugagcgccgggaacggcuccagcgagguggaggugguccccuuccaggaggugugggggcgguccuacugccgcgcccucgagcggcugguggacgucgugagcgaguaccccuccgagguggagcacauguucagccccuccugcgucagccugcuccgcugcaccggcugcugcggggacgagaaccugcacugcgugcccguggagaccgccaacgucacgaugcagcugcucaagauccgguccggcgaccgcccgagcuacguggagcugaccuucucccagcacgugcggugcgagugccgcccccugcgggagaagaugaagcccgagcgccggcgccccaagggccgggggaagcgccggcgcgagaagcagcggccgaccgacugccaccucugcggcgacgcggucccccgccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6408 - RNA, 1515 nt, Artificial Sequence
  mRNA product Design5 comprising derived and/or modified sequence from Homo sapiens__NP_001020537.2__HsVEGFA (opt1)
gggagagucccgcagucggcguccagcggcucugcuuguucgugugugugucguugcaggccuuauucaagcuuaccaugaccgaccgccagaccgacacggcccccagcccguccuaccaccuccugcccggccggcgccggaccguggacgccgcggccagccgcgggcagggccccgagcccgcccccgggggcggggucgagggcgugggcgcccgcgggguggcccugaagcuguucguccagcuccugggcugcucccgguucgggggcgcgguggugcgggccggggaggccgagcccagcggcgccgcgcgcuccgccagcuccggccgggaggagccccagcccgaggagggggaggaggaggaggagaaggaggaggagcgcggcccgcaguggcggcugggggcccgcaagcccggcagcuggaccggcgaggccgccgucugcgcggacuccgcccccgccgcccgggccccgcaggcgcucgcccgcgccagcgggcggggcgggcgcguggcccggcgcggcgccgaggaguccgggccgccccacagccccucccggcgcggcagcgcgucccgggccggccccgggcgcgccagcgagaccaugaacuuccugcuguccugggugcacuggagccucgcccugcugcucuaccugcaccacgccaaguggucccaggcggccccgauggccgagggcgggggccagaaccaccacgaggucgugaaguucauggacguguaccagcgcagcuacugccaccccaucgagacgcuggucgacaucuuccaggaguaccccgacgagaucgaguacaucuucaagcccagcugcgugccgcucaugcggugcgggggcugcugcaacgacgagggccuggagugcgugcccaccgaggaguccaacaucaccaugcagaucaugcgcaucaagccccaccaggggcagcacaucggcgagaugagcuuccugcagcacaacaagugcgagugccggcccaagaaggaccgcgcccggcaggagaagaaguccguccgcgggaagggcaaggggcagaagcggaagcgcaagaagucccgguacaagagcuggagcguguacgugggcgcgcgcugcugccucaugccguggucccugcccggcccccaccccugcgggccgugcagcgagcggcgcaagcaccuguucguccaggacccccagaccugcaagugcuccugcaagaacacggacagccggugcaaggcccgccagcucgagcugaacgagcggaccugccgcugcgacaagccccggcgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6409 - RNA, 975 nt, Artificial Sequence
  mRNA product Design5 comprising derived and/or modified sequence from Homo sapiens__NP_001165094.1__HsVEGFA (opt1)
gggagagucccgcagucggcguccagcggcucugcuuguucgugugugugucguugcaggccuuauucaagcuuaccaugaacuuccugcucagcugggugcacuggucccuggcccugcuccuguaccugcaccacgccaaguggagccaggcggcccccauggccgagggcgggggccagaaccaccacgaggucgugaaguucauggacguguaccagcgcuccuacugccacccgaucgagacccucgucgacaucuuccaggaguaccccgacgagaucgaguacaucuucaagcccagcugcgugccccugaugcggugcgggggcugcugcaacgacgaggggcuggagugcgugccgaccgaggaguccaacaucacgaugcagaucaugcgcaucaagccccaccagggccagcacaucggcgagaugagcuuccuccagcacaacaagugcgagugccggcccaagaaggaccgcgcccggcaggagaagaaguccguccgcgggaagggcaaggggcagaagcggaagcgcaagaagucccgguacaagagcuggagcguguacgugggcgcccgcugcugccugaugcccuggucccugccggggccccaccccugcggccccugcagcgagcggcgcaagcaccucuucguccaggacccgcagaccugcaagugcuccugcaagaacaccgacagccggugcaaggcgcgccagcuggagcugaacgagcggaccugccgcugcgacaagccccggcgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6410 - RNA, 900 nt, Artificial Sequence
  mRNA product Design5 comprising derived and/or modified sequence from Homo sapiens__NP_003368.1__HsVEGFB (opt1)
gggagagucccgcagucggcguccagcggcucugcuuguucgugugugugucguugcaggccuuauucaagcuuaccaugagcccccugcuccgccggcugcugcucgccgcccugcugcagcucgcgccggcccaggcccccgugucccagcccgacgcccccggccaccagcgcaaggucgugagcuggaucgacguguacacccgggcgaccugccagccgcgcgaggucguggugccccugacggucgagcugauggggaccguggccaagcagcucgugcccuccugcgucaccgugcagcggugcggcgggugcugccccgacgacggccuggagugcgugccgaccgggcagcaccagguccgcaugcagauccugaugauccgguaccccagcucccagcucggcgagaugagccuggaggagcacucccagugcgagugccgccccaagaagaaggacagcgccgugaagcccgaccgggccgccacgccgcaccaccgcccccagccccgguccgugcccggcugggacagcgcgccgggggcccccucccccgccgacaucacccaccccaccccggcccccggccccagcgcccacgcggcccccuccaccacgagcgcccugaccccggggcccgccgccgcggccgccgacgccgccgcguccagcgucgccaagggcggggccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6411 - RNA, 1536 nt, Artificial Sequence
  mRNA product Design5 comprising derived and/or modified sequence from Homo sapiens__NP_005420.1__HsVEGFC (opt1)
gggagagucccgcagucggcguccagcggcucugcuuguucgugugugugucguugcaggccuuauucaagcuuaccaugcaccuccugggcuucuucagcguggccugcucccugcuggccgcggcccuccugcccgggccgcgcgaggcccccgccgccgcggccgccuucgagagcggccuggaccucuccgacgccgagcccgacgcgggggaggccaccgccuacgccagcaaggaccuggaggagcagcugcgguccgucagcuccguggacgagcucaugaccgugcuguaccccgaguacuggaagauguacaagugccagcugcgcaagggcggguggcagcacaaccgggagcaggccaaccucaacagccgcacggaggagaccaucaaguucgcggccgcccacuacaacaccgagauccugaaguccaucgacaacgaguggcggaagacccagugcaugccgcgcgaggucugcaucgacgugggcaaggaguucggcguggccacgaacaccuucuucaagccgcccugcgucagcguguaccggugcgggggcugcugcaacuccgaggggcugcagugcaugaacaccagcaccuccuaccucagcaagacgcuguucgagaucaccgugccccugucccagggccccaagcccgucaccaucagcuucgccaaccacaccuccugccgcugcaugagcaagcucgacguguaccgccaggugcacuccaucauccggcggagccugcccgcgacgcugccccagugccaggccgccaacaagaccugcccgaccaacuacauguggaacaaccacaucugccgcugccucgcccaggaggacuucauguucagcuccgacgccggggacgacagcaccgacggcuuccacgacaucugcggccccaacaaggagcuggacgaggagacgugccagugcgucugccgggcggggcugcgccccgccuccugcggcccccacaaggagcucgaccggaacagcugccagugcgugugcaagaacaagcuguucccgucccagugcggggccaaccgcgaguucgacgagaacacgugccagugcgugugcaagcggaccugcccccgcaaccagccccugaaccccggcaagugcgccugcgagugcaccgagagcccgcagaagugccuccugaagggcaagaaguuccaccaccagaccugcuccugcuaccggcgccccugcaccaaccggcagaaggccugcgagcccggguucagcuacuccgaggaggucugccgcugcgugcccagcuacuggaagcgcccgcagauguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6412 - RNA, 1341 nt, Artificial Sequence
  mRNA product Design5 comprising derived and/or modified sequence from Homo sapiens__NP_004460.1__HsVEGFD (opt1)
gggagagucccgcagucggcguccagcggcucugcuuguucgugugugugucguugcaggccuuauucaagcuuaccauguaccgcgaguggguggucgugaacguguucaugaugcuguacguccagcucgugcagggcagcuccaacgagcacgggcccgugaagcggagcucccagagcacccuggagcgcuccgagcagcagauccgggccgccagcucccuggaggagcuccugcgcaucacccacagcgaggacuggaagcuguggcggugccgccuccggcugaaguccuucacgagcauggacucccgcagcgcgucccaccggagcacccgcuucgccgccaccuucuacgacaucgagacccugaaggucaucgacgaggaguggcagcggacgcagugcuccccgcgcgagaccugcguggagguggccagcgagcucggcaaguccaccaacaccuucuucaagccgcccugcgucaacguguuccggugcgggggcugcugcaacgaggagagccugaucugcaugaacacguccaccagcuacaucagcaagcagcuguucgagaucuccgugccccucaccagcguccccgagcuggugcccgugaaggucgccaaccacaccgggugcaagugccugcccacggcgccccgccacccguacuccaucauccggcgcagcauccagauccccgaggaggaccggugcucccacagcaagaagcucugccccaucgacaugcugugggacuccaacaagugcaagugcgugcugcaggaggagaacccccucgccggcaccgaggaccacagccaccuccaggagccggcccugugcggcccccacaugauguucgacgaggaccgcugcgagugcgugugcaagacccccugccccaaggaccugauccagcacccgaagaacugcuccugcuucgagugcaaggagagccuggagaccugcugccagaagcacaagcuguuccaccccgacacgugcuccugcgaggaccggugccccuuccacacccgccccugcgccagcgggaagaccgcgugcgccaagcacugccgguucccgaaggagaagcgcgccgcccagggcccccacucccgcaagaaccccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6413 - RNA, 906 nt, Artificial Sequence
  mRNA product Design5 comprising derived and/or modified sequence from Homo sapiens__NP_061986.1__HsFGF21 (opt2)
gggagagucccgcagucggcguccagcggcucugcuuguucgugugugugucguugcaggccuuauucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcuccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggccccucccagggccgcucccccuccuacgccuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6414 - RNA, 1686 nt, Artificial Sequence
  mRNA product Design5 comprising derived and/or modified sequence from Homo sapiens__NP_002412.1__HsMMP1 (opt2)
gggagagucccgcagucggcguccagcggcucugcuuguucgugugugugucguugcaggccuuauucaagcuuaccaugcacuccuuccccccccuccuccuccuccucuucuggggcgucgucucccacuccuuccccgccacccucgagacccaggagcaggacgucgaccucguccagaaguaccucgagaaguacuacaaccucaagaacgacggccgccaggucgagaagcgccgcaacuccggccccgucgucgagaagcucaagcagaugcaggaguucuucggccucaaggucaccggcaagcccgacgccgagacccucaaggucaugaagcagccccgcugcggcguccccgacgucgcccaguucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6415 - RNA, 1446 nt, Artificial Sequence
  mRNA product Design5 comprising derived and/or modified sequence from Homo sapiens__NP_002412.1__HsMMP1(1-19,100-469) (opt2)
gggagagucccgcagucggcguccagcggcucugcuuguucgugugugugucguugcaggccuuauucaagcuuaccaugcacuccuuccccccccuccuccuccuccucuucuggggcgucgucucccacuccuucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6416 - RNA, 3633 nt, Artificial Sequence
  mRNA product Design5 comprising derived and/or modified sequence from Clostridium histolyticum__BAA77453.1__ColG (opt2)
gggagagucccgcagucggcguccagcggcucugcuuguucgugugugugucguugcaggccuuauucaagcuuaccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6417 - RNA, 3357 nt, Artificial Sequence
  mRNA product Design5 comprising derived and/or modified sequence from Clostridium histolyticum__BAA77453.1__HsALB(1-18)_ColG(111-1118) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6418 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6419 - RNA, 3381 nt, Artificial Sequence
  mRNA product Design5 comprising derived and/or modified sequence from Clostridium histolyticum__BAA34542.1__ColH (opt2)
gggagagucccgcagucggcguccagcggcucugcuuguucgugugugugucguugcaggccuuauucaagcuuaccaugaacuuccucaagaucauccucaaccgcggcaagaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6420 - RNA, 3342 nt, Artificial Sequence
  mRNA product Design5 comprising derived and/or modified sequence from Clostridium histolyticum__BAA34542.1__ColH (opt2)
gggagagucccgcagucggcguccagcggcucugcuuguucgugugugugucguugcaggccuuauucaagcuuaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6421 - RNA, 3276 nt, Artificial Sequence
  mRNA product Design5 comprising derived and/or modified sequence from Clostridium histolyticum__BAA34542.1__HsALB(1-18)_ColH(41-1021) (opt2)
gggagagucccgcagucggcguccagcggcucugcuuguucgugugugugucguugcaggccuuauucaagcuuaccaugaagugggucaccuucaucucccuccucuuccucuucuccuccgccuacuccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6422 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaugaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6423 - RNA, 852 nt, Artificial Sequence
  mRNA product Design5 comprising derived and/or modified sequence from Homo sapiens__NP_001133.1__HsAMELX (opt2)
gggagagucccgcagucggcguccagcggcucugcuuguucgugugugugucguugcaggccuuauucaagcuuaccaugggcaccuggauccucuucgccugccuccucggcgccgccuucgccaugccccuccccccccaccccggccaccccggcuacaucaacuucuccuacgagguccucaccccccucaagugguaccaguccauccgcccccccuaccccuccuacggcuacgagcccaugggcggcuggcuccaccaccagaucauccccguccucucccagcagcacccccccacccacacccuccagccccaccaccacauccccgucguccccgcccagcagcccgucaucccccagcagcccaugaugcccguccccggccagcacuccaugacccccauccagcaccaccagcccaaccuccccccccccgcccagcagcccuaccagccccagcccguccagccccagccccaccagcccaugcagccccagccccccguccaccccaugcagccccuccccccccagcccccccucccccccauguuccccaugcagccccucccccccaugcuccccgaccucacccucgaggccuggcccuccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6424 - RNA, 411 nt, Artificial Sequence
  mRNA product Design5 comprising derived and/or modified sequence from Homo sapiens__NP_001133.1__HsAMELX-TRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccaguccauccgcccccccuaccccuccuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6425 - RNA, 444 nt, Artificial Sequence
  mRNA product Design5 comprising derived and/or modified sequence from Homo sapiens__NP_001133.1__HsAMELX-LRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccaguccauccgccccccccccaugcuccccgaccucacccucgaggccuggcccuccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6426 - RNA, 483 nt, Artificial Sequence
  mRNA product Design5 comprising derived and/or modified sequence from Homo sapiens__NP_001133.1__HLA-A2-SP_HsAMELX(17-60) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccauccgcccccccuaccccuccuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6427 - RNA, 516 nt, Artificial Sequence
  mRNA product Design5 comprising derived and/or modified sequence from Homo sapiens__NP_001133.1__HLA-A2-SP_HsAMELX(17-47,168-191) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccauccgccccccccccaugcuccccgaccucacccucgaggccuggcccuccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6428 - RNA, 855 nt, Artificial Sequence
  mRNA product Design5 comprising derived and/or modified sequence from Homo sapiens__NP_001134.1__HsAMELY (opt2)
gggagagucccgcagucggcguccagcggcucugcuuguucgugugugugucguugcaggccuuauucaagcuuaccaugggcaccuggauccucuucgccugccucgucggcgccgccuucgccaugccccuccccccccaccccggccaccccggcuacaucaacuucuccuacgagguccucaccccccucaagugguaccaguccaugauccgcccccccuacuccuccuacggcuacgagcccaugggcggcuggcuccaccaccagaucauccccgucgucucccagcagcacccccucacccacacccuccagucccaccaccacauccccgucguccccgcccagcagccccgcguccgccagcaggcccucaugcccguccccggccagcaguccaugacccccacccagcaccaccagcccaaccucccccuccccgcccagcagcccuuccagccccagcccguccagccccagccccaccagcccaugcagccccagccccccguccagcccaugcagccccuccucccccagcccccccucccccccauguucccccuccgcccccucccccccauccuccccgaccuccaccucgaggccuggcccgccaccgacaagaccaagcaggaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6429 - RNA, 414 nt, Artificial Sequence
  mRNA product Design5 comprising derived and/or modified sequence from Homo sapiens__NP_001134.1__HsAMELY-TRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccaguccaugauccgcccccccuacuccuccuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6430 - RNA, 447 nt, Artificial Sequence
  mRNA product Design5 comprising derived and/or modified sequence from Homo sapiens__NP_001134.1__HsAMELY-LRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccaguccaugauccgccccccccccauccuccccgaccuccaccucgaggccuggcccgccaccgacaagaccaagcaggaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6431 - RNA, 486 nt, Artificial Sequence
  mRNA product Design5 comprising derived and/or modified sequence from Homo sapiens__NP_001134.1__HLA-A2-SP_HsAMELY(17-61) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccaugauccgcccccccuacuccuccuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6432 - RNA, 519 nt, Artificial Sequence
  mRNA product Design5 comprising derived and/or modified sequence from Homo sapiens__NP_001134.1__HLA-A2-SP_HsAMELY(17-48,169-192) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccaugauccgccccccccccauccuccccgaccuccaccucgaggccuggcccgccaccgacaagaccaagcaggaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6433 - RNA, 846 nt, Artificial Sequence
  mRNA product Design5 comprising derived and/or modified sequence from Sus scrofa__NP_999071.1__SsAMELX-001-1 (opt2)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6434 - RNA, 414 nt, Artificial Sequence
  mRNA product Design5 comprising derived and/or modified sequence from Sus scrofa__NP_999071.1__SsAMELX-TRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccagaacaugauccgccaccccuacaccuccuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6435 - RNA, 447 nt, Artificial Sequence
  mRNA product Design5 comprising derived and/or modified sequence from Sus scrofa__NP_999071.1__SsAMELX-LRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6436 - RNA, 486 nt, Artificial Sequence
  mRNA product Design5 comprising derived and/or modified sequence from Sus scrofa__NP_999071.1__HLA-A2-SP_SsAMEL(17-61) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccagaacaugauccgccaccccuacaccuccuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6437 - RNA, 519 nt, Artificial Sequence
  mRNA product Design5 comprising derived and/or modified sequence from Sus scrofa__NP_999071.1__HLA-A2-SP_SsAMEL(17-49,167-189) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6438 - RNA, 810 nt, Artificial Sequence
  mRNA product Design5 comprising derived and/or modified sequence from Sus scrofa__P45561-2__SsAMELX-001-2 (opt2)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6439 - RNA, 846 nt, Artificial Sequence
  mRNA product Design5 comprising derived and/or modified sequence from Sus scrofa__NP_998965.1__SsAMELX-001-3 (opt2)
gggagagucccgcagucggcguccagcggcucugcuuguucgugugugugucguugcaggccuuauucaagcuuaccaugggcaccuggaucuucuucgccugccuccucggcgccucccucgccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6440 - RNA, 495 nt, Artificial Sequence
  mRNA product Design5 comprising derived and/or modified sequence from Sus scrofa__K7GPB2__SsAMELX-002 (opt2)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6441 - RNA, 888 nt, Artificial Sequence
  mRNA product Design5 comprising derived and/or modified sequence from Sus scrofa__K7GLD0__SsAMELX-003 (opt2)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacgaggaccucuaccucgaggccauccgcaucgaccgcaccgccuucguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6442 - RNA, 774 nt, Artificial Sequence
  mRNA product Design5 comprising derived and/or modified sequence from Sus scrofa__K7GPE9__SsAMELX-004 (opt2)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6443 - RNA, 798 nt, Artificial Sequence
  mRNA product Design5 comprising derived and/or modified sequence from Sus scrofa__J9JIM4__SsAMELX-201 (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6444 - RNA, 3237 nt, Artificial Sequence
  mRNA product Design5 comprising derived and/or modified sequence from Homo sapiens__NP_006120.1__HsBMP1 (opt2)
gggagagucccgcagucggcguccagcggcucugcuuguucgugugugugucguugcaggccuuauucaagcuuaccaugcccggcgucgcccgccucccccuccuccucggccuccuccuccucccccgccccggccgcccccucgaccucgccgacuacaccuacgaccucgccgaggaggacgacuccgagccccucaacuacaaggaccccugcaaggccgccgccuuccucggcgacaucgcccucgacgaggaggaccuccgcgccuuccagguccagcaggccgucgaccuccgccgccacaccgcccgcaaguccuccaucaaggccgccguccccggcaacaccuccacccccuccugccaguccaccaacggccagccccagcgcggcgccugcggccgcuggcgcggccgcucccgcucccgccgcgccgccaccucccgccccgagcgcgucuggcccgacggcgucauccccuucgucaucggcggcaacuucaccggcucccagcgcgccgucuuccgccaggccaugcgccacugggagaagcacaccugcgucaccuuccucgagcgcaccgacgaggacuccuacaucgucuucaccuaccgccccugcggcugcugcuccuacgucggccgccgcggcggcggcccccaggccaucuccaucggcaagaacugcgacaaguucggcaucgucguccacgagcucggccacgucgucggcuucuggcacgagcacacccgccccgaccgcgaccgccacgucuccaucguccgcgagaacauccagcccggccaggaguacaacuuccucaagauggagccccaggaggucgagucccucggcgagaccuacgacuucgacuccaucaugcacuacgcccgcaacaccuucucccgcggcaucuuccucgacaccaucguccccaaguacgaggucaacggcgucaagccccccaucggccagcgcacccgccucuccaagggcgacaucgcccaggcccgcaagcucuacaagugccccgccugcggcgagacccuccaggacuccaccggcaacuucuccucccccgaguaccccaacggcuacuccgcccacaugcacugcgucuggcgcaucuccgucacccccggcgagaagaucauccucaacuucaccucccucgaccucuaccgcucccgccucugcugguacgacuacgucgagguccgcgacggcuucuggcgcaaggccccccuccgcggccgcuucugcggcuccaagcuccccgagcccaucgucuccaccgacucccgccucugggucgaguuccgcuccuccuccaacugggucggcaagggcuucuucgccgucuacgaggccaucugcggcggcgacgucaagaaggacuacggccacauccagucccccaacuaccccgacgacuaccgccccuccaaggucugcaucuggcgcauccaggucuccgagggcuuccacgucggccucaccuuccaguccuucgagaucgagcgccacgacuccugcgccuacgacuaccucgagguccgcgacggccacuccgaguccuccacccucaucggccgcuacugcggcuacgagaagcccgacgacaucaaguccaccuccucccgccucuggcucaaguucgucuccgacggcuccaucaacaaggccggcuucgccgucaacuucuucaaggaggucgacgagugcucccgccccaaccgcggcggcugcgagcagcgcugccucaacacccucggcuccuacaagugcuccugcgaccccggcuacgagcucgcccccgacaagcgccgcugcgaggccgccugcggcggcuuccucaccaagcucaacggcuccaucaccucccccggcuggcccaaggaguacccccccaacaagaacugcaucuggcagcucgucgcccccacccaguaccgcaucucccuccaguucgacuucuucgagaccgagggcaacgacgucugcaaguacgacuucgucgagguccgcuccggccucaccgccgacuccaagcuccacggcaaguucugcggcuccgagaagcccgaggucaucaccucccaguacaacaacaugcgcgucgaguucaaguccgacaacaccgucuccaagaagggcuucaaggcccacuucuucuccgacaaggacgagugcuccaaggacaacggcggcugccagcaggacugcgucaacaccuucggcuccuacgagugccagugccgcuccggcuucguccuccacgacaacaagcacgacugcaaggaggccggcugcgaccacaaggucaccuccaccuccggcaccaucaccucccccaacuggcccgacaaguaccccuccaagaaggagugcaccugggccaucuccuccacccccggccaccgcgucaagcucaccuucauggagauggacaucgagucccagcccgagugcgccuacgaccaccucgaggucuucgacggccgcgacgccaaggcccccguccucggccgcuucugcggcuccaagaagcccgagcccguccucgccaccggcucccgcauguuccuccgcuucuacuccgacaacuccguccagcgcaagggcuuccaggccucccacgccaccgagugcggcggccagguccgcgccgacgucaagaccaaggaccucuacucccacgcccaguucggcgacaacaacuaccccggcggcgucgacugcgagugggucaucgucgccgaggagggcuacggcgucgagcucgucuuccagaccuucgaggucgaggaggagaccgacugcggcuacgacuacauggagcucuucgacggcuacgacuccaccgccccccgccucggccgcuacugcggcuccggcccccccgaggaggucuacuccgccggcgacuccguccucgucaaguuccacuccgacgacaccaucaccaagaagggcuuccaccuccgcuacaccuccaccaaguuccaggacacccuccacucccgcaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6445 - RNA, 1467 nt, Artificial Sequence
  mRNA product Design5 comprising derived and/or modified sequence from Homo sapiens__NP_001191.1__HsBMP2 (opt2)
gggagagucccgcagucggcguccagcggcucugcuuguucgugugugugucguugcaggccuuauucaagcuuaccauggucgccggcacccgcugccuccucgcccuccuccucccccagguccuccucggcggcgccgccggccucguccccgagcucggccgccgcaaguucgccgccgccuccuccggccgccccuccucccagcccuccgacgagguccucuccgaguucgagcuccgccuccucuccauguucggccucaagcagcgccccacccccucccgcgacgccgucgucccccccuacaugcucgaccucuaccgccgccacuccggccagcccggcucccccgcccccgaccaccgccucgagcgcgccgccucccgcgccaacaccguccgcuccuuccaccacgaggagucccucgaggagcuccccgagaccuccggcaagaccacccgccgcuucuucuucaaccucuccuccauccccaccgaggaguucaucaccuccgccgagcuccaggucuuccgcgagcagaugcaggacgcccucggcaacaacuccuccuuccaccaccgcaucaacaucuacgagaucaucaagcccgccaccgccaacuccaaguuccccgucacccgccuccucgacacccgccucgucaaccagaacgccucccgcugggaguccuucgacgucacccccgccgucaugcgcuggaccgcccagggccacgccaaccacggcuucgucgucgaggucgcccaccucgaggagaagcagggcgucuccaagcgccacguccgcaucucccgcucccuccaccaggacgagcacuccuggucccagauccgcccccuccucgucaccuucggccacgacggcaagggccacccccuccacaagcgcgagaagcgccaggccaagcacaagcagcgcaagcgccucaaguccuccugcaagcgccacccccucuacgucgacuucuccgacgucggcuggaacgacuggaucgucgccccccccggcuaccacgccuucuacugccacggcgagugccccuucccccucgccgaccaccucaacuccaccaaccacgccaucguccagacccucgucaacuccgucaacuccaagauccccaaggccugcugcguccccaccgagcucuccgccaucuccaugcucuaccucgacgagaacgagaaggucguccucaagaacuaccaggacauggucgucgagggcugcggcugccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6446 - RNA, 1503 nt, Artificial Sequence
  mRNA product Design5 comprising derived and/or modified sequence from Homo sapiens__NP_001193.2__HsBMP4 (opt2)
gggagagucccgcagucggcguccagcggcucugcuuguucgugugugugucguugcaggccuuauucaagcuuaccaugauccccggcaaccgcaugcucauggucguccuccucugccagguccuccucggcggcgccucccacgccucccucauccccgagaccggcaagaagaaggucgccgagauccagggccacgccggcggccgccgcuccggccagucccacgagcuccuccgcgacuucgaggccacccuccuccagauguucggccuccgccgccgcccccagcccuccaaguccgccgucauccccgacuacaugcgcgaccucuaccgccuccaguccggcgaggaggaggaggagcagauccacuccaccggccucgaguaccccgagcgccccgccucccgcgccaacaccguccgcuccuuccaccacgaggagcaccucgagaacauccccggcaccuccgagaacuccgccuuccgcuuccucuucaaccucuccuccauccccgagaacgaggucaucuccuccgccgagcuccgccucuuccgcgagcaggucgaccagggccccgacugggagcgcggcuuccaccgcaucaacaucuacgaggucaugaagccccccgccgaggucguccccggccaccucaucacccgccuccucgacacccgccucguccaccacaacgucacccgcugggagaccuucgacgucucccccgccguccuccgcuggacccgcgagaagcagcccaacuacggccucgccaucgaggucacccaccuccaccagacccgcacccaccagggccagcacguccgcaucucccgcucccucccccagggcuccggcaacugggcccagcuccgcccccuccucgucaccuucggccacgacggccgcggccacgcccucacccgccgccgccgcgccaagcgcucccccaagcaccacucccagcgcgcccgcaagaagaacaagaacugccgccgccacucccucuacgucgacuucuccgacgucggcuggaacgacuggaucgucgccccccccggcuaccaggccuucuacugccacggcgacugccccuucccccucgccgaccaccucaacuccaccaaccacgccaucguccagacccucgucaacuccgucaacuccuccauccccaaggccugcugcguccccaccgagcucuccgccaucuccaugcucuaccucgacgaguacgacaaggucguccucaagaacuaccaggagauggucgucgagggcugcggcugccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6447 - RNA, 1818 nt, Artificial Sequence
  mRNA product Design5 comprising derived and/or modified sequence from Homo sapiens__NP_001709.1__HsBMP6 (opt2)
gggagagucccgcagucggcguccagcggcucugcuuguucgugugugugucguugcaggccuuauucaagcuuaccaugcccggccucggccgccgcgcccaguggcucugcuggugguggggccuccucugcuccugcugcggcccccccccccuccgccccccccuccccgccgccgccgccgccgccgccggcggccagcuccucggcgacggcggcucccccggccgcaccgagcagcccccccccuccccccaguccuccuccggcuuccucuaccgccgccucaagacccaggagaagcgcgagaugcagaaggagauccucuccguccucggccucccccaccgcccccgcccccuccacggccuccagcagccccagccccccgcccuccgccagcaggaggagcagcagcagcagcagcagcucccccgcggcgagcccccccccggccgccucaaguccgccccccucuucaugcucgaccucuacaacgcccucuccgccgacaacgacgaggacggcgccuccgagggcgagcgccagcaguccuggccccacgaggccgccuccuccucccagcgccgccagcccccccccggcgccgcccacccccucaaccgcaagucccuccucgcccccggcuccggcuccggcggcgccuccccccucaccuccgcccaggacuccgccuuccucaacgacgccgacauggucauguccuucgucaaccucgucgaguacgacaaggaguucuccccccgccagcgccaccacaaggaguucaaguucaaccucucccagauccccgagggcgaggucgucaccgccgccgaguuccgcaucuacaaggacugcgucaugggcuccuucaagaaccagaccuuccucaucuccaucuaccagguccuccaggagcaccagcaccgcgacuccgaccucuuccuccucgacacccgcgucgucugggccuccgaggagggcuggcucgaguucgacaucaccgccaccuccaaccucugggucgucaccccccagcacaacaugggccuccagcucuccgucgucacccgcgacggcguccacguccacccccgcgccgccggccucgucggccgcgacggccccuacgacaagcagcccuucauggucgccuucuucaaggucuccgagguccacguccgcaccacccgcuccgccuccucccgccgccgccagcagucccgcaaccgcuccacccagucccaggacgucgcccgcgucuccuccgccuccgacuacaacuccuccgagcucaagaccgccugccgcaagcacgagcucuacgucuccuuccaggaccucggcuggcaggacuggaucaucgcccccaagggcuacgccgccaacuacugcgacggcgagugcuccuucccccucaacgcccacaugaacgccaccaaccacgccaucguccagacccucguccaccucaugaaccccgaguacguccccaagcccugcugcgcccccaccaagcucaacgccaucuccguccucuacuucgacgacaacuccaacgucauccucaagaaguaccgcaacauggucguccgcgccugcggcugccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6448 - RNA, 1572 nt, Artificial Sequence
  mRNA product Design5 comprising derived and/or modified sequence from Homo sapiens__NP_001710.1__HsBMP7 (opt2)
gggagagucccgcagucggcguccagcggcucugcuuguucgugugugugucguugcaggccuuauucaagcuuaccaugcacguccgcucccuccgcgccgccgccccccacuccuucgucgcccucugggccccccucuuccuccuccgcuccgcccucgccgacuucucccucgacaacgagguccacuccuccuucauccaccgccgccuccgcucccaggagcgccgcgagaugcagcgcgagauccucuccauccucggccucccccaccgcccccgcccccaccuccagggcaagcacaacuccgcccccauguucaugcucgaccucuacaacgccauggccgucgaggagggcggcggccccggcggccagggcuucuccuaccccuacaaggccgucuucuccacccagggccccccccucgccucccuccaggacucccacuuccucaccgacgccgacauggucauguccuucgucaaccucgucgagcacgacaaggaguucuuccacccccgcuaccaccaccgcgaguuccgcuucgaccucuccaagauccccgagggcgaggccgucaccgccgccgaguuccgcaucuacaaggacuacauccgcgagcgcuucgacaacgagaccuuccgcaucuccgucuaccagguccuccaggagcaccucggccgcgaguccgaccucuuccuccucgacucccgcacccucugggccuccgaggagggcuggcucgucuucgacaucaccgccaccuccaaccacugggucgucaacccccgccacaaccucggccuccagcucuccgucgagacccucgacggccaguccaucaaccccaagcucgccggccucaucggccgccacggcccccagaacaagcagcccuucauggucgccuucuucaaggccaccgagguccacuuccgcuccauccgcuccaccggcuccaagcagcgcucccagaaccgcuccaagacccccaagaaccaggaggcccuccgcauggccaacgucgccgagaacuccuccuccgaccagcgccaggccugcaagaagcacgagcucuacgucuccuuccgcgaccucggcuggcaggacuggaucaucgcccccgagggcuacgccgccuacuacugcgagggcgagugcgccuucccccucaacuccuacaugaacgccaccaaccacgccaucguccagacccucguccacuucaucaaccccgagaccguccccaagcccugcugcgcccccacccagcucaacgccaucuccguccucuacuucgacgacuccuccaacgucauccucaagaaguaccgcaacauggucguccgcgccugcggcugccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6449 - RNA, 576 nt, Artificial Sequence
  mRNA product Design5 comprising derived and/or modified sequence from Homo sapiens__NP_006264.2__HsCCL7 (opt2)
gggagagucccgcagucggcguccagcggcucugcuuguucgugugugugucguugcaggccuuauucaagcuuaccaugaaggccuccgccgcccuccucugccuccuccucaccgccgccgccuucuccccccagggccucgcccagcccgucggcaucaacaccuccaccaccugcugcuaccgcuucaucaacaagaagauccccaagcagcgccucgaguccuaccgccgcaccaccuccucccacugcccccgcgaggccgucaucuucaagaccaagcucgacaaggagaucugcgccgaccccacccagaaguggguccaggacuucaugaagcaccucgacaagaagacccagacccccaagcucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6450 - RNA, 3900 nt, Artificial Sequence
  mRNA product Design5 comprising derived and/or modified sequence from Homo sapiens__NP_001954.2__HsEGF (opt2)
gggagagucccgcagucggcguccagcggcucugcuuguucgugugugugucguugcaggccuuauucaagcuuaccaugcuccucacccucaucauccuccuccccgucgucuccaaguucuccuucgucucccucuccgccccccagcacugguccugccccgagggcacccucgccggcaacggcaacuccaccugcgucggccccgcccccuuccucaucuucucccacggcaacuccaucuuccgcaucgacaccgagggcaccaacuacgagcagcucgucgucgacgccggcgucuccgucaucauggacuuccacuacaacgagaagcgcaucuacugggucgaccucgagcgccagcuccuccagcgcgucuuccucaacggcucccgccaggagcgcgucugcaacaucgagaagaacgucuccggcauggccaucaacuggaucaacgaggaggucaucugguccaaccagcaggagggcaucaucaccgucaccgacaugaagggcaacaacucccacauccuccucuccgcccucaaguaccccgccaacgucgccgucgaccccgucgagcgcuucaucuucugguccuccgaggucgccggcucccucuaccgcgccgaccucgacggcgucggcgucaaggcccuccucgagaccuccgagaagaucaccgccgucucccucgacguccucgacaagcgccucuucuggauccaguacaaccgcgagggcuccaacucccucaucugcuccugcgacuacgacggcggcuccguccacaucuccaagcaccccacccagcacaaccucuucgccaugucccucuucggcgaccgcaucuucuacuccaccuggaagaugaagaccaucuggaucgccaacaagcacaccggcaaggacaugguccgcaucaaccuccacuccuccuucgucccccucggcgagcucaaggucguccacccccucgcccagcccaaggccgaggacgacaccugggagcccgagcagaagcucugcaagcuccgcaagggcaacugcuccuccaccgucugcggccaggaccuccagucccaccucugcaugugcgccgagggcuacgcccucucccgcgaccgcaaguacugcgaggacgucaacgagugcgccuucuggaaccacggcugcacccucggcugcaagaacacccccggcuccuacuacugcaccugccccgucggcuucguccuccuccccgacggcaagcgcugccaccagcucgucuccugcccccgcaacgucuccgagugcucccacgacugcguccucaccuccgagggcccccucugcuucugccccgagggcuccguccucgagcgcgacggcaagaccugcuccggcugcuccucccccgacaacggcggcugcucccagcucugcgucccccucucccccgucuccugggagugcgacugcuuccccggcuacgaccuccagcucgacgagaaguccugcgccgccuccggcccccagcccuuccuccucuucgccaacucccaggacauccgccacaugcacuucgacggcaccgacuacggcacccuccucucccagcagaugggcauggucuacgcccucgaccacgaccccgucgagaacaagaucuacuucgcccacaccgcccucaaguggaucgagcgcgccaacauggacggcucccagcgcgagcgccucaucgaggagggcgucgacguccccgagggccucgccgucgacuggaucggccgccgcuucuacuggaccgaccgcggcaagucccucaucggccgcuccgaccucaacggcaagcgcuccaagaucaucaccaaggagaacaucucccagccccgcggcaucgccguccaccccauggccaagcgccucuucuggaccgacaccggcaucaacccccgcaucgaguccuccucccuccagggccucggccgccucgucaucgccuccuccgaccucaucuggcccuccggcaucaccaucgacuuccucaccgacaagcucuacuggugcgacgccaagcaguccgucaucgagauggccaaccucgacggcuccaagcgccgccgccucacccagaacgacgucggccaccccuucgccgucgccgucuucgaggacuacgucugguucuccgacugggccaugcccuccgucaugcgcgucaacaagcgcaccggcaaggaccgcguccgccuccagggcuccaugcucaagcccuccucccucgucgucguccacccccucgccaagcccggcgccgaccccugccucuaccagaacggcggcugcgagcacaucugcaagaagcgccucggcaccgccuggugcuccugccgcgagggcuucaugaaggccuccgacggcaagaccugccucgcccucgacggccaccagcuccucgccggcggcgaggucgaccucaagaaccaggucaccccccucgacauccucuccaagacccgcgucuccgaggacaacaucaccgagucccagcacaugcucgucgccgagaucauggucuccgaccaggacgacugcgcccccgucggcugcuccauguacgcccgcugcaucuccgagggcgaggacgccaccugccagugccucaagggcuucgccggcgacggcaagcucugcuccgacaucgacgagugcgagaugggcguccccgucugcccccccgccuccuccaagugcaucaacaccgagggcggcuacgucugccgcugcuccgagggcuaccagggcgacggcauccacugccucgacaucgacgagugccagcucggcgagcacuccugcggcgagaacgccuccugcaccaacaccgagggcggcuacaccugcaugugcgccggccgccucuccgagcccggccucaucugccccgacuccaccccccccccccaccuccgcgaggacgaccaccacuacuccguccgcaacuccgacuccgagugcccccucucccacgacggcuacugccuccacgacggcgucugcauguacaucgaggcccucgacaaguacgccugcaacugcgucgucggcuacaucggcgagcgcugccaguaccgcgaccucaaguggugggagcuccgccacgccggccacggccagcagcagaaggucaucgucgucgccgucugcgucgucguccucgucaugcuccuccuccucucccucuggggcgcccacuacuaccgcacccagaagcuccucuccaagaaccccaagaaccccuacgaggaguccucccgcgacguccgcucccgccgccccgccgacaccgaggacggcauguccuccugcccccagcccugguucgucgucaucaaggagcaccaggaccucaagaacggcggccagcccgucgccggcgaggacggccaggccgccgacggcuccaugcagcccaccuccuggcgccaggagccccagcucugcggcaugggcaccgagcagggcugcuggauccccgucuccuccgacaagggcuccugcccccaggucauggagcgcuccuuccacaugcccuccuacggcacccagacccucgagggcggcgucgagaagccccacucccuccucuccgccaacccccucuggcagcagcgcgcccucgaccccccccaccagauggagcucacccagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6451 - RNA, 786 nt, Artificial Sequence
  mRNA product Design5 comprising derived and/or modified sequence from Homo sapiens__NP_001423.1__HsEREG (opt2)
gggagagucccgcagucggcguccagcggcucugcuuguucgugugugugucguugcaggccuuauucaagcuuaccaugaccgccggccgccgcauggagaugcucugcgccggccgcguccccgcccuccuccucugccucggcuuccaccuccuccaggccguccucuccaccaccgucauccccuccugcauccccggcgaguccuccgacaacugcaccgcccucguccagaccgaggacaacccccgcgucgcccaggucuccaucaccaagugcuccuccgacaugaacggcuacugccuccacggccagugcaucuaccucgucgacaugucccagaacuacugccgcugcgaggucggcuacaccggcguccgcugcgagcacuucuuccucaccguccaccagccccucuccaaggaguacgucgcccucaccgucauccucaucauccucuuccucaucaccgucgucggcuccaccuacuacuucugccgcugguaccgcaaccgcaaguccaaggagcccaagaaggaguacgagcgcgucaccuccggcgaccccgagcucccccaggucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6452 - RNA, 744 nt, Artificial Sequence
  mRNA product Design5 comprising derived and/or modified sequence from Homo sapiens__NP_000791.1__HsFGF1 (opt2)
gggagagucccgcagucggcguccagcggcucugcuuguucgugugugugucguugcaggccuuauucaagcuuaccauggccgagggcgagaucaccaccuucaccgcccucaccgagaaguucaaccucccccccggcaacuacaagaagcccaagcuccucuacugcuccaacggcggccacuuccuccgcauccuccccgacggcaccgucgacggcacccgcgaccgcuccgaccagcacauccagcuccagcucuccgccgaguccgucggcgaggucuacaucaaguccaccgagaccggccaguaccucgccauggacaccgacggccuccucuacggcucccagacccccaacgaggagugccucuuccucgagcgccucgaggagaaccacuacaacaccuacaucuccaagaagcacgccgagaagaacugguucgucggccucaagaagaacggcuccugcaagcgcggcccccgcacccacuacggccagaaggccauccucuuccucccccuccccgucuccuccgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6453 - RNA, 1143 nt, Artificial Sequence
  mRNA product Design5 comprising derived and/or modified sequence from Homo sapiens__NP_001997.5__HsFGF2 (opt2)
gggagagucccgcagucggcguccagcggcucugcuuguucgugugugugucguugcaggccuuauucaagcuuaccauggucggcgucggcggcggcgacgucgaggacgucaccccccgccccggcggcugccagaucuccggccgcggcgcccgcggcugcaacggcauccccggcgccgccgccugggaggccgcccucccccgccgccgcccccgccgccaccccuccgucaacccccgcucccgcgccgccggcuccccccgcacccgcggccgccgcaccgaggagcgccccuccggcucccgccucggcgaccgcggccgcggccgcgcccuccccggcggccgccucggcggccgcggccgcggccgcgcccccgagcgcgucggcggccgcggccgcggccgcggcaccgccgccccccgcgccgcccccgccgcccgcggcucccgccccggccccgccggcaccauggccgccggcuccaucaccacccuccccgcccuccccgaggacggcggcuccggcgccuucccccccggccacuucaaggaccccaagcgccucuacugcaagaacggcggcuucuuccuccgcauccaccccgacggccgcgucgacggcguccgcgagaaguccgacccccacaucaagcuccagcuccaggccgaggagcgcggcgucgucuccaucaagggcgucugcgccaaccgcuaccucgccaugaaggaggacggccgccuccucgccuccaagugcgucaccgacgagugcuucuucuucgagcgccucgaguccaacaacuacaacaccuaccgcucccgcaaguacaccuccugguacgucgcccucaagcgcaccggccaguacaagcucggcuccaagaccggccccggccagaaggccauccucuuccuccccauguccgccaaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6454 - RNA, 861 nt, Artificial Sequence
  mRNA product Design5 comprising derived and/or modified sequence from Homo sapiens__NP_002000.1__HsFGF7 (opt2)
gggagagucccgcagucggcguccagcggcucugcuuguucgugugugugucguugcaggccuuauucaagcuuaccaugcacaaguggauccucaccuggauccuccccacccuccucuaccgcuccugcuuccacaucaucugccucgucggcaccaucucccucgccugcaacgacaugacccccgagcagauggccaccaacgucaacugcuccucccccgagcgccacacccgcuccuacgacuacauggagggcggcgacauccgcguccgccgccucuucugccgcacccagugguaccuccgcaucgacaagcgcggcaaggucaagggcacccaggagaugaagaacaacuacaacaucauggagauccgcaccgucgccgucggcaucgucgccaucaagggcgucgaguccgaguucuaccucgccaugaacaaggagggcaagcucuacgccaagaaggagugcaacgaggacugcaacuucaaggagcucauccucgagaaccacuacaacaccuacgccuccgccaaguggacccacaacggcggcgagauguucgucgcccucaaccagaagggcauccccguccgcggcaagaagaccaagaaggagcagaagaccgcccacuuccuccccauggccaucaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6455 - RNA, 903 nt, Artificial Sequence
  mRNA product Design5 comprising derived and/or modified sequence from Homo sapiens__NP_001936.1__HsHBEGF (opt2)
gggagagucccgcagucggcguccagcggcucugcuuguucgugugugugucguugcaggccuuauucaagcuuaccaugaagcuccuccccuccgucguccucaagcucuuccucgccgccguccucuccgcccucgucaccggcgagucccucgagcgccuccgccgcggccucgccgccggcaccuccaaccccgacccccccaccgucuccaccgaccagcuccucccccucggcggcggccgcgaccgcaagguccgcgaccuccaggaggccgaccucgaccuccuccgcgucacccucuccuccaagccccaggcccucgccacccccaacaaggaggagcacggcaagcgcaagaagaagggcaagggccucggcaagaagcgcgaccccugccuccgcaaguacaaggacuucugcauccacggcgagugcaaguacgucaaggagcuccgcgcccccuccugcaucugccaccccggcuaccacggcgagcgcugccacggccucucccuccccgucgagaaccgccucuacaccuacgaccacaccaccauccucgccgucgucgccgucguccucuccuccgucugccuccucgucaucgucggccuccucauguuccgcuaccaccgccgcggcggcuacgacgucgagaacgaggagaaggucaagcucggcaugaccaacucccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6456 - RNA, 2463 nt, Artificial Sequence
  mRNA product Design5 comprising derived and/or modified sequence from Homo sapiens__NP_000592.3__HsHGF (opt2)
gggagagucccgcagucggcguccagcggcucugcuuguucgugugugugucguugcaggccuuauucaagcuuaccaugugggucaccaagcuccuccccgcccuccuccuccagcacguccuccuccaccuccuccuccuccccaucgccauccccuacgccgagggccagcgcaagcgccgcaacaccauccacgaguucaagaaguccgccaagaccacccucaucaagaucgaccccgcccucaagaucaagaccaagaaggucaacaccgccgaccagugcgccaaccgcugcacccgcaacaagggccuccccuucaccugcaaggccuucgucuucgacaaggcccgcaagcagugccucugguuccccuucaacuccauguccuccggcgucaagaaggaguucggccacgaguucgaccucuacgagaacaaggacuacauccgcaacugcaucaucggcaagggccgcuccuacaagggcaccgucuccaucaccaaguccggcaucaagugccagcccugguccuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccucauggaccacaccgaguccggcaagaucugccagcgcugggaccaccagaccccccaccgccacaaguuccuccccgagcgcuaccccgacaagggcuucgacgacaacuacugccgcaaccccgacggccagccccgccccuggugcuacacccucgacccccacacccgcugggaguacugcgccaucaagaccugcgccgacaacaccaugaacgacaccgacgucccccucgagaccaccgagugcauccagggccagggcgagggcuaccgcggcaccgucaacaccaucuggaacggcauccccugccagcgcugggacucccaguacccccacgagcacgacaugacccccgagaacuucaagugcaaggaccuccgcgagaacuacugccgcaaccccgacggcuccgagucccccuggugcuucaccaccgaccccaacauccgcgucggcuacugcucccagauccccaacugcgacaugucccacggccaggacugcuaccgcggcaacggcaagaacuacaugggcaaccucucccagacccgcuccggccucaccugcuccaugugggacaagaacauggaggaccuccaccgccacaucuucugggagcccgacgccuccaagcucaacgagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccgcaccaacaucggcuggauggucucccuccgcuaccgcaacaagcacaucugcggcggcucccucaucaaggaguccuggguccucaccgcccgccagugcuuccccucccgcgaccucaaggacuacgaggccuggcucggcauccacgacguccacggccgcggcgacgagaagugcaagcagguccucaacgucucccagcucgucuacggccccgagggcuccgaccucguccucaugaagcucgcccgccccgccguccucgacgacuucgucuccaccaucgaccuccccaacuacggcugcaccauccccgagaagaccuccugcuccgucuacggcuggggcuacaccggccucaucaacuacgacggccuccuccgcgucgcccaccucuacaucaugggcaacgagaagugcucccagcaccaccgcggcaaggucacccucaacgaguccgagaucugcgccggcgccgagaagaucggcuccggccccugcgagggcgacuacggcggcccccucgucugcgagcagcacaagaugcgcaugguccucggcgucaucguccccggccgcggcugcgccauccccaaccgccccggcaucuucguccgcgucgccuacuacgccaaguggauccacaagaucauccucaccuacaaggucccccaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6457 - RNA, 2202 nt, Artificial Sequence
  mRNA product Design5 comprising derived and/or modified sequence from Homo sapiens__NP_005336.3 __HsHSPA1A (opt2)
gggagagucccgcagucggcguccagcggcucugcuuguucgugugugugucguugcaggccuuauucaagcuuaccauggccaaggccgccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgcccucaacccccagaacaccgucuucgacgccaagcgccucaucggccgcaaguucggcgaccccgucguccaguccgacaugaagcacuggcccuuccaggucaucaacgacggcgacaagcccaagguccaggucuccuacaagggcgagaccaaggccuucuaccccgaggagaucuccuccaugguccucaccaagaugaaggagaucgccgaggccuaccucggcuaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgaccgcaccggcaagggcgagcgcaacguccucaucuucgaccucggcggcggcaccuucgacgucuccauccucaccaucgacgacggcaucuucgaggucaaggccaccgccggcgacacccaccucggcggcgaggacuucgacaaccgccucgucaaccacuucgucgaggaguucaagcgcaagcacaagaaggacaucucccagaacaagcgcgccguccgccgccuccgcaccgccugcgagcgcgccaagcgcacccucuccuccuccacccaggccucccucgagaucgacucccucuucgagggcaucgacuucuacaccuccaucacccgcgcccgcuucgaggagcucugcuccgaccucuuccgcuccacccucgagcccgucgagaaggcccuccgcgacgccaagcucgacaaggcccagauccacgaccucguccucgucggcggcuccacccgcauccccaagguccagaagcuccuccaggacuucuucaacggccgcgaccucaacaaguccaucaaccccgacgaggccgucgccuacggcgccgccguccaggccgccauccucaugggcgacaaguccgagaacguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucaacgucaccgccaccgacaaguccaccggcaaggccaacaagaucaccaucaccaacgacaagggccgccucuccaaggaggagaucgagcgcaugguccaggaggccgagaaguacaaggccgaggacgagguccagcgcgagcgcgucuccgccaagaacgcccucgaguccuacgccuucaacaugaaguccgccgucgaggacgagggccucaagggcaagaucuccgaggccgacaagaagaagguccucgacaagugccaggaggucaucuccuggcucgacgccaacacccucgccgagaaggacgaguucgagcacaagcgcaaggagcucgagcaggucugcaaccccaucaucuccggccucuaccagggcgccggcggccccggccccggcggcuucggcgcccagggccccaagggcggcuccggcuccggccccaccaucgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6458 - RNA, 2202 nt, Artificial Sequence; identical to SEQ ID NO: 6457
  mRNA product Design5 comprising derived and/or modified sequence from Homo sapiens__NP_005337.2 __HsHSPA1B (opt2)

SEQ ID NO: 6459 - RNA, 2202 nt, Artificial Sequence
  mRNA product Design5 comprising derived and/or modified sequence from Homo sapiens__NP_005518.3 __HsHSPA1L (opt2)
gggagagucccgcagucggcguccagcggcucugcuuguucgugugugugucguugcaggccuuauucaagcuuaccauggccaccgccaagggcaucgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaacccccagaacaccgucuucgacgccaagcgccucaucggccgcaaguucaacgaccccgucguccaggccgacaugaagcucuggcccuuccaggucaucaacgagggcggcaagcccaagguccucgucuccuacaagggcgagaacaaggccuucuaccccgaggagaucuccuccaugguccucaccaagcucaaggagaccgccgaggccuuccucggccaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgacaagggcggccagggcgagcgccacguccucaucuucgaccucggcggcggcaccuucgacgucuccauccucaccaucgacgacggcaucuucgaggucaaggccaccgccggcgacacccaccucggcggcgaggacuucgacaaccgccucgucucccacuucgucgaggaguucaagcgcaagcacaagaaggacaucucccagaacaagcgcgccguccgccgccuccgcaccgccugcgagcgcgccaagcgcacccucuccuccuccacccaggccaaccucgagaucgacucccucuacgagggcaucgacuucuacaccuccaucacccgcgcccgcuucgaggagcucugcgccgaccucuuccgcggcacccucgagcccgucgagaaggcccuccgcgacgccaagauggacaaggccaagauccacgacaucguccucgucggcggcuccacccgcauccccaagguccagcgccuccuccaggacuacuucaacggccgcgaccucaacaaguccaucaaccccgacgaggccgucgccuacggcgccgccguccaggccgccauccucaugggcgacaaguccgagaagguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgaccucaccggcaucccccccgccccccgcggcgucccccagaucgaggucaccuucgacaucgacgccaacggcauccucaacgucaccgccaccgacaaguccaccggcaaggucaacaagaucaccaucaccaacgacaagggccgccucuccaaggaggagaucgagcgcaugguccucgacgccgagaaguacaaggccgaggacgagguccagcgcgagaagaucgccgccaagaacgcccucgaguccuacgccuucaacaugaaguccgucgucuccgacgagggccucaagggcaagaucuccgaguccgacaagaacaagauccucgacaagugcaacgagcuccucuccuggcucgaggucaaccagcucgccgagaaggacgaguucgaccacaagcgcaaggagcucgagcagaugugcaaccccaucaucaccaagcucuaccagggcggcugcaccggccccgccugcggcaccggcuacguccccggccgccccgccaccggccccaccaucgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6460 - RNA, 2196 nt, Artificial Sequence
  mRNA product Design5 comprising derived and/or modified sequence from Homo sapiens__NP_068814.2 __HsHSPA2 (opt2)
gggagagucccgcagucggcguccagcggcucugcuuguucgugugugugucguugcaggccuuauucaagcuuaccauguccgcccgcggccccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccaucuucgacgccaagcgccucaucggccgcaaguucgaggacgccaccguccaguccgacaugaagcacuggcccuuccgcgucgucuccgagggcggcaagcccaagguccaggucgaguacaagggcgagaccaagaccuucuuccccgaggagaucuccuccaugguccucaccaagaugaaggagaucgccgaggccuaccucggcggcaagguccacuccgccgucaucaccguccccgccuacuucaacgacucccagcgccaggccaccaaggacgccggcaccaucaccggccucaacguccuccgcaucaucaacgagcccaccgccgccgccaucgccuacggccucgacaagaagggcugcgccggcggcgagaagaacguccucaucuucgaccucggcggcggcaccuucgacgucuccauccucaccaucgaggacggcaucuucgaggucaaguccaccgccggcgacacccaccucggcggcgaggacuucgacaaccgcauggucucccaccucgccgaggaguucaagcgcaagcacaagaaggacaucggccccaacaagcgcgccguccgccgccuccgcaccgccugcgagcgcgccaagcgcacccucuccuccuccacccaggccuccaucgagaucgacucccucuacgagggcgucgacuucuacaccuccaucacccgcgcccgcuucgaggagcucaacgccgaccucuuccgcggcacccucgagcccgucgagaaggcccuccgcgacgccaagcucgacaagggccagauccaggagaucguccucgucggcggcuccacccgcauccccaagauccagaagcuccuccaggacuucuucaacggcaaggagcucaacaaguccaucaaccccgacgaggccgucgccuacggcgccgccguccaggccgccauccucaucggcgacaaguccgagaacguccaggaccuccuccuccucgacgucaccccccucucccucggcaucgagaccgccggcggcgucaugaccccccucaucaagcgcaacaccaccauccccaccaagcagacccagaccuucaccaccuacuccgacaaccaguccuccguccucguccaggucuacgagggcgagcgcgccaugaccaaggacaacaaccuccucggcaaguucgaccucaccggcaucccccccgccccccgcggcgucccccagaucgaggucaccuucgacaucgacgccaacggcauccucaacgucaccgccgccgacaaguccaccggcaaggagaacaagaucaccaucaccaacgacaagggccgccucuccaaggacgacaucgaccgcaugguccaggaggccgagcgcuacaaguccgaggacgaggccaaccgcgaccgcgucgccgccaagaacgcccucgaguccuacaccuacaacaucaagcagaccgucgaggacgagaagcuccgcggcaagaucuccgagcaggacaagaacaagauccucgacaagugccaggaggucaucaacuggcucgaccgcaaccagauggccgagaaggacgaguacgagcacaagcagaaggagcucgagcgcgucugcaaccccaucaucuccaagcucuaccagggcggccccggcggcggcuccggcggcggcggcuccggcgccuccggcggccccaccaucgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6461 - RNA, 2799 nt, Artificial Sequence
  mRNA product Design5 comprising derived and/or modified sequence from Homo sapiens__NP_002145.3 __HsHSPA4 (opt2)
gggagagucccgcagucggcguccagcggcucugcuuguucgugugugugucguugcaggccuuauucaagcuuaccauguccgucgucggcaucgaccucggcuuccaguccugcuacgucgccgucgcccgcgccggcggcaucgagaccaucgccaacgaguacuccgaccgcugcacccccgccugcaucuccuucggccccaagaaccgcuccaucggcgccgccgccaagucccaggucaucuccaacgccaagaacaccguccagggcuucaagcgcuuccacggccgcgccuucuccgaccccuucgucgaggccgagaaguccaaccucgccuacgacaucguccagcuccccaccggccucaccggcaucaaggucaccuacauggaggaggagcgcaacuucaccaccgagcaggucaccgccaugcuccucuccaagcucaaggagaccgccgaguccguccucaagaagcccgucgucgacugcgucgucuccguccccugcuucuacaccgacgccgagcgccgcuccgucauggacgccacccagaucgccggccucaacugccuccgccucaugaacgagaccaccgccgucgcccucgccuacggcaucuacaagcaggaccuccccgcccucgaggagaagccccgcaacgucgucuucgucgacaugggccacuccgccuaccaggucuccgucugcgccuucaaccgcggcaagcucaagguccucgccaccgccuucgacaccacccucggcggccgcaaguucgacgagguccucgucaaccacuucugcgaggaguucggcaagaaguacaagcucgacaucaaguccaagauccgcgcccuccuccgccucucccaggagugcgagaagcucaagaagcucauguccgccaacgccuccgaccucccccucuccaucgagugcuucaugaacgacgucgacgucuccggcaccaugaaccgcggcaaguuccucgagaugugcaacgaccuccucgcccgcgucgagcccccccuccgcuccguccucgagcagaccaagcucaagaaggaggacaucuacgccgucgagaucgucggcggcgccacccgcauccccgccgucaaggagaagaucuccaaguucuucggcaaggagcucuccaccacccucaacgccgacgaggccgucacccgcggcugcgcccuccagugcgccauccucucccccgccuucaagguccgcgaguucuccaucaccgacgucguccccuaccccaucucccuccgcuggaacucccccgccgaggagggcuccuccgacugcgaggucuucuccaagaaccacgccgcccccuucuccaagguccucaccuucuaccgcaaggagcccuucacccucgaggccuacuacuccuccccccaggaccuccccuaccccgaccccgccaucgcccaguucuccguccagaaggucaccccccaguccgacggcuccuccuccaaggucaaggucaagguccgcgucaacguccacggcaucuucuccgucuccuccgccucccucgucgagguccacaaguccgaggagaacgaggagcccauggagaccgaccagaacgccaaggaggaggagaagaugcaggucgaccaggaggagccccacgucgaggagcagcagcagcagacccccgccgagaacaaggccgaguccgaggagauggagaccucccaggccggcuccaaggacaagaagauggaccagcccccccaggccaagaaggccaaggucaagaccuccaccgucgaccuccccaucgagaaccagcuccucuggcagaucgaccgcgagaugcucaaccucuacaucgagaacgagggcaagaugaucaugcaggacaagcucgagaaggagcgcaacgacgccaagaacgccgucgaggaguacgucuacgagaugcgcgacaagcucuccggcgaguacgagaaguucgucuccgaggacgaccgcaacuccuucacccucaagcucgaggacaccgagaacuggcucuacgaggacggcgaggaccagcccaagcaggucuacgucgacaagcucgccgagcucaagaaccucggccagcccaucaagauccgcuuccaggaguccgaggagcgccccaagcucuucgaggagcucggcaagcagauccagcaguacaugaagaucaucuccuccuucaagaacaaggaggaccaguacgaccaccucgacgccgccgacaugaccaaggucgagaaguccaccaacgaggccauggaguggaugaacaacaagcucaaccuccagaacaagcagucccucaccauggaccccgucgucaaguccaaggagaucgaggccaagaucaaggagcucaccuccaccugcucccccaucaucuccaagcccaagcccaaggucgagccccccaaggaggagcagaagaacgccgagcagaacggccccgucgacggccagggcgacaaccccggcccccaggccgccgagcagggcaccgacaccgccguccccuccgacuccgacaagaagcuccccgagauggacaucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6462 - RNA, 2796 nt, Artificial Sequence
  mRNA product Design5 comprising derived and/or modified sequence from Homo sapiens__NP_055093.2 __HsHSPA4L (opt2)
gggagagucccgcagucggcguccagcggcucugcuuguucgugugugugucguugcaggccuuauucaagcuuaccauguccgucgucggcaucgaccucggcuuccucaacugcuacaucgccgucgcccgcuccggcggcaucgagaccaucgccaacgaguacuccgaccgcugcacccccgccugcaucucccucggcucccgcacccgcgccaucggcaacgccgccaagucccagaucgucaccaacguccgcaacaccauccacggcuucaagaagcuccacggccgcuccuucgacgaccccaucguccagaccgagcgcauccgccuccccuacgagcuccagaagaugcccaacggcuccgccggcgucaagguccgcuaccucgaggaggagcgccccuucgccaucgagcaggucaccggcaugcuccucgccaagcucaaggagaccuccgagaacgcccucaagaagcccgucgccgacugcgucaucuccauccccuccuucuucaccgacgccgagcgccgcuccgucauggccgccgcccaggucgccggccucaacugccuccgccucaugaacgagaccaccgccgucgcccucgccuacggcaucuacaagcaggaccuccccccccucgacgagaagccccgcaacgucgucuucaucgacaugggccacuccgccuaccagguccucgucugcgccuucaacaagggcaagcucaagguccucgccaccaccuucgaccccuaccucggcggccgcaacuucgacgaggcccucgucgacuacuucugcgacgaguucaagaccaaguacaagaucaacgucaaggagaacucccgcgcccuccuccgccucuaccaggagugcgagaagcucaagaagcucauguccgccaacgccuccgaccucccccucaacaucgagugcuucaugaacgaccucgacgucuccuccaagaugaaccgcgcccaguucgagcagcucugcgccucccuccucgcccgcgucgagcccccccucaaggccgucauggagcaggccaaccuccagcgcgaggacaucuccuccaucgagaucgucggcggcgccacccgcauccccgccgucaaggagcagaucaccaaguucuuccucaaggacaucuccaccacccucaacgccgacgaggccgucgcccgcggcugcgcccuccagugcgccauccucucccccgccuucaagguccgcgaguucuccaucaccgaccucguccccuacuccaucacccuccgcuggaagaccuccuucgaggacggcuccggcgagugcgaggucuucugcaagaaccaccccgcccccuucuccaaggucaucaccuuccacaagaaggagcccuucgagcucgaggccuucuacaccaaccuccacgagguccccuaccccgacgcccgcaucggcuccuucaccauccagaacgucuucccccaguccgacggcgacuccuccaaggucaaggucaagguccgcgucaacauccacggcaucuucuccgucgccuccgccuccgucaucgagaagcagaaccucgagggcgaccacuccgacgcccccauggagaccgagaccuccuucaagaacgagaacaaggacaacauggacaagaugcaggucgaccaggaggagggccaccagaagugccacgccgagcacacccccgaggaggagaucgaccacaccggcgccaagaccaaguccgccgucuccgacaagcaggaccgccucaaccagacccucaagaagggcaaggucaaguccaucgaccuccccauccaguccucccucugccgccagcucggccaggaccuccucaacuccuacaucgagaacgagggcaagaugaucaugcaggacaagcucgagaaggagcgcaacgacgccaagaacgccgucgaggaguacgucuacgacuuccgcgaccgccucggcaccgucuacgagaaguucaucacccccgaggaccucuccaagcucuccgccguccucgaggacaccgagaacuggcucuacgaggacggcgaggaccagcccaagcaggucuacgucgacaagcuccaggagcucaagaaguacggccagcccauccagaugaaguacauggagcacgaggagcgccccaaggcccucaacgaccucggcaagaagauccagcucgucaugaaggucaucgaggccuaccgcaacaaggacgagcgcuacgaccaccucgaccccaccgagauggagaaggucgagaagugcaucuccgacgccauguccuggcucaacuccaagaugaacgcccagaacaagcucucccucacccaggaccccgucgucaaggucuccgagaucgucgccaaguccaaggagcucgacaacuucugcaaccccaucaucuacaagcccaagcccaaggccgagguccccgaggacaagcccaaggccaacuccgagcacaacggccccauggacggccaguccggcaccgagaccaaguccgacuccaccaaggacuccucccagcacaccaaguccuccggcgagauggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6463 - RNA, 2241 nt, Artificial Sequence
  mRNA product Design5 comprising derived and/or modified sequence from Homo sapiens__NP_005338.1__HsHSPA5 (opt2)
gggagagucccgcagucggcguccagcggcucugcuuguucgugugugugucguugcaggccuuauucaagcuuaccaugaagcucucccucgucgccgccaugcuccuccuccucuccgccgcccgcgccgaggaggaggacaagaaggaggacgucggcaccgucgucggcaucgaccucggcaccaccuacuccugcgucggcgucuucaagaacggccgcgucgagaucaucgccaacgaccagggcaaccgcaucacccccuccuacgucgccuucacccccgagggcgagcgccucaucggcgacgccgccaagaaccagcucaccuccaaccccgagaacaccgucuucgacgccaagcgccucaucggccgcaccuggaacgaccccuccguccagcaggacaucaaguuccuccccuucaaggucgucgagaagaagaccaagcccuacauccaggucgacaucggcggcggccagaccaagaccuucgcccccgaggagaucuccgccaugguccucaccaagaugaaggagaccgccgaggccuaccucggcaagaaggucacccacgccgucgucaccguccccgccuacuucaacgacgcccagcgccaggccaccaaggacgccggcaccaucgccggccucaacgucaugcgcaucaucaacgagcccaccgccgccgccaucgccuacggccucgacaagcgcgagggcgagaagaacauccucgucuucgaccucggcggcggcaccuucgacgucucccuccucaccaucgacaacggcgucuucgaggucgucgccaccaacggcgacacccaccucggcggcgaggacuucgaccagcgcgucauggagcacuucaucaagcucuacaagaagaagaccggcaaggacguccgcaaggacaaccgcgccguccagaagcuccgccgcgaggucgagaaggccaagcgcgcccucuccucccagcaccaggcccgcaucgagaucgaguccuucuacgagggcgaggacuucuccgagacccucacccgcgccaaguucgaggagcucaacauggaccucuuccgcuccaccaugaagcccguccagaagguccucgaggacuccgaccucaagaaguccgacaucgacgagaucguccucgucggcggcuccacccgcauccccaagauccagcagcucgucaaggaguucuucaacggcaaggagcccucccgcggcaucaaccccgacgaggccgucgccuacggcgccgccguccaggccggcguccucuccggcgaccaggacaccggcgaccucguccuccucgacgucugcccccucacccucggcaucgagaccgucggcggcgucaugaccaagcucaucccccgcaacaccgucguccccaccaagaagucccagaucuucuccaccgccuccgacaaccagcccaccgucaccaucaaggucuacgagggcgagcgcccccucaccaaggacaaccaccuccucggcaccuucgaccucaccggcaucccccccgccccccgcggcgucccccagaucgaggucaccuucgagaucgacgucaacggcauccuccgcgucaccgccgaggacaagggcaccggcaacaagaacaagaucaccaucaccaacgaccagaaccgccucacccccgaggagaucgagcgcauggucaacgacgccgagaaguucgccgaggaggacaagaagcucaaggagcgcaucgacacccgcaacgagcucgaguccuacgccuacucccucaagaaccagaucggcgacaaggagaagcucggcggcaagcucuccuccgaggacaaggagaccauggagaaggccgucgaggagaagaucgaguggcucgagucccaccaggacgccgacaucgaggacuucaaggccaagaagaaggagcucgaggagaucguccagcccaucaucuccaagcucuacggcuccgccggccccccccccaccggcgaggaggacaccgccgagaaggacgagcucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6464 - RNA, 2208 nt, Artificial Sequence
  mRNA product Design5 comprising derived and/or modified sequence from Homo sapiens__NP_002146.2__HsHSPA6 (opt2)
gggagagucccgcagucggcguccagcggcucugcuuguucgugugugugucguugcaggccuuauucaagcuuaccaugcaggccccccgcgagcucgccgucggcaucgaccucggcaccaccuacuccugcgucggcgucuuccagcagggccgcgucgagauccucgccaacgaccagggcaaccgcaccacccccuccuacgucgccuucaccgacaccgagcgccucgucggcgacgccgccaagucccaggccgcccucaacccccacaacaccgucuucgacgccaagcgccucaucggccgcaaguucgccgacaccaccguccaguccgacaugaagcacuggcccuuccgcgucgucuccgagggcggcaagcccaagguccgcgucugcuaccgcggcgaggacaagaccuucuaccccgaggagaucuccuccaugguccucuccaagaugaaggagaccgccgaggccuaccucggccagcccgucaagcacgccgucaucaccguccccgccuacuucaacgacucccagcgccaggccaccaaggacgccggcgccaucgccggccucaacguccuccgcaucaucaacgagcccaccgccgccgccaucgccuacggccucgaccgccgcggcgccggcgagcgcaacguccucaucuucgaccucggcggcggcaccuucgacgucuccguccucuccaucgacgccggcgucuucgaggucaaggccaccgccggcgacacccaccucggcggcgaggacuucgacaaccgccucgucaaccacuucauggaggaguuccgccgcaagcacggcaaggaccucuccggcaacaagcgcgcccuccgccgccuccgcaccgccugcgagcgcgccaagcgcacccucuccuccuccacccaggccacccucgagaucgacucccucuucgagggcgucgacuucuacaccuccaucacccgcgcccgcuucgaggagcucugcuccgaccucuuccgcuccacccucgagcccgucgagaaggcccuccgcgacgccaagcucgacaaggcccagauccacgacgucguccucgucggcggcuccacccgcauccccaagguccagaagcuccuccaggacuucuucaacggcaaggagcucaacaaguccaucaaccccgacgaggccgucgccuacggcgccgccguccaggccgccguccucaugggcgacaagugcgagaagguccaggaccuccuccuccucgacgucgccccccucucccucggccucgagaccgccggcggcgucaugaccacccucauccagcgcaacgccaccauccccaccaagcagacccagaccuucaccaccuacuccgacaaccagcccggcgucuucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucuccgucaccgccaccgaccgcuccaccggcaaggccaacaagaucaccaucaccaacgacaagggccgccucuccaaggaggaggucgagcgcaugguccacgaggccgagcaguacaaggccgaggacgaggcccagcgcgaccgcgucgccgccaagaacucccucgaggcccacgucuuccacgucaagggcucccuccaggaggagucccuccgcgacaagauccccgaggaggaccgccgcaagaugcaggacaagugccgcgagguccucgccuggcucgagcacaaccagcucgccgagaaggaggaguacgagcaccagaagcgcgagcucgagcagaucugccgccccaucuucucccgccucuacggcggccccggcguccccggcggcuccuccugcggcacccaggcccgccagggcgaccccuccaccggccccaucaucgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6465 - RNA, 1380 nt, Artificial Sequence
  mRNA product Design5 comprising derived and/or modified sequence from Homo sapiens__P48741__HsHSPA7 (opt2)
gggagagucccgcagucggcguccagcggcucugcuuguucgugugugugucguugcaggccuuauucaagcuuaccaugcaggccccccgcgagcucgccgucggcaucgaccucggcaccaccuacuccugcgucggcgucuuccagcagggccgcgucgagauccucgccaacgaccagggcaaccgcaccacccccuccuacgucgccuucaccgacaccgagcgccucgucggcgacgccgccaagucccaggccgcccucaacccccacaacaccgucuucgacgccaagcgccucaucggccgcaaguucgccgacaccaccguccaguccgacaugaagcacuggcccuuccaggucgucuccgagggcggcaagcccaagguccgcgucugcuaccgcggcgaggacaagaccuucuaccccgaggagaucuccuccaugguccucuccaagaugaaggagaccgccgaggccuaccucggccagcccgucaagcacgccgucaucaccguccccaccuacuucuccaacucccagcgccaggccaccaaggacgccggcgccaucgccggccucaagguccuccccaucaucaacgaggccaccgccgccgccaucgccuacggccucgaccgccgcggcgccggcaagcgcaacguccucaucuucgaccucggcggcggcaccuucgacgucuccguccucuccaucgacgccggcgucuucgaggucaaggccaccgccggcgacacccaccucggcggcgaggacuucgacaaccgccucgucaaccacuucauggaggaguuccgccgcaagcacggcaaggaccucuccggcaacaagcgcgcccuccgccgccuccgcaccgccugcgagcgcgccaagcgcacccccuccuccuccacccaggccacccucgagaucgacucccucuucgagggcgucgacuucuacaaguccaucacccgcgcccgcuucgaggagcucugcuccgaccucuuccgcuccacccucgagcccgucgagaaggcccuccgcgacgccaagcucgacaaggcccagauccacgacuucguccucggcggcggccuccacucccacccccagggcgccgaggucgccgccggccuccuccagcgccagggcgccgagcaggagcaccagcccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6466 - RNA, 2217 nt, Artificial Sequence
  mRNA product Design5 comprising derived and/or modified sequence from Homo sapiens__NP_006588.1 __HsHSPA8 (opt2)
gggagagucccgcagucggcguccagcggcucugcuuguucgugugugugucguugcaggccuuauucaagcuuaccauguccaagggccccgccgucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccgucuucgacgccaagcgccucaucggccgccgcuucgacgacgccgucguccaguccgacaugaagcacuggcccuucauggucgucaacgacgccggccgccccaagguccaggucgaguacaagggcgagaccaaguccuucuaccccgaggaggucuccuccaugguccucaccaagaugaaggagaucgccgaggccuaccucggcaagaccgucaccaacgccgucgucaccguccccgccuacuucaacgacucccagcgccaggccaccaaggacgccggcaccaucgccggccucaacguccuccgcaucaucaacgagcccaccgccgccgccaucgccuacggccucgacaagaaggucggcgccgagcgcaacguccucaucuucgaccucggcggcggcaccuucgacgucuccauccucaccaucgaggacggcaucuucgaggucaaguccaccgccggcgacacccaccucggcggcgaggacuucgacaaccgcauggucaaccacuucaucgccgaguucaagcgcaagcacaagaaggacaucuccgagaacaagcgcgccguccgccgccuccgcaccgccugcgagcgcgccaagcgcacccucuccuccuccacccaggccuccaucgagaucgacucccucuacgagggcaucgacuucuacaccuccaucacccgcgcccgcuucgaggagcucaacgccgaccucuuccgcggcacccucgaccccgucgagaaggcccuccgcgacgccaagcucgacaagucccagauccacgacaucguccucgucggcggcuccacccgcauccccaagauccagaagcuccuccaggacuucuucaacggcaaggagcucaacaaguccaucaaccccgacgaggccgucgccuacggcgccgccguccaggccgccauccucuccggcgacaaguccgagaacguccaggaccuccuccuccucgacgucaccccccucucccucggcaucgagaccgccggcggcgucaugaccguccucaucaagcgcaacaccaccauccccaccaagcagacccagaccuucaccaccuacuccgacaaccagcccggcguccucauccaggucuacgagggcgagcgcgccaugaccaaggacaacaaccuccucggcaaguucgagcucaccggcaucccccccgccccccgcggcgucccccagaucgaggucaccuucgacaucgacgccaacggcauccucaacgucuccgccgucgacaaguccaccggcaaggagaacaagaucaccaucaccaacgacaagggccgccucuccaaggaggacaucgagcgcaugguccaggaggccgagaaguacaaggccgaggacgagaagcagcgcgacaaggucuccuccaagaacucccucgaguccuacgccuucaacaugaaggccaccgucgaggacgagaagcuccagggcaagaucaacgacgaggacaagcagaagauccucgacaagugcaacgagaucaucaacuggcucgacaagaaccagaccgccgagaaggaggaguucgagcaccagcagaaggagcucgagaaggucugcaaccccaucaucaccaagcucuaccaguccgccggcggcaugcccggcggcaugcccggcggcuuccccggcggcggcgccccccccuccggcggcgccuccuccggccccaccaucgaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6467 - RNA, 2316 nt, Artificial Sequence
  mRNA product Design5 comprising derived and/or modified sequence from Homo sapiens__NP_004125.3 __HsHSPA9 (opt2)
gggagagucccgcagucggcguccagcggcucugcuuguucgugugugugucguugcaggccuuauucaagcuuaccaugaucuccgccucccgcgccgccgccgcccgccucgucggcgccgccgccucccgcggccccaccgccgcccgccaccaggacuccuggaacggccucucccacgaggccuuccgccucgucucccgccgcgacuacgccuccgaggccaucaagggcgccgucgucggcaucgaccucggcaccaccaacuccugcgucgccgucauggagggcaagcaggccaagguccucgagaacgccgagggcgcccgcaccacccccuccgucgucgccuucaccgccgacggcgagcgccucgucggcaugcccgccaagcgccaggccgucaccaaccccaacaacaccuucuacgccaccaagcgccucaucggccgccgcuacgacgaccccgagguccagaaggacaucaagaacguccccuucaagaucguccgcgccuccaacggcgacgccugggucgaggcccacggcaagcucuacucccccucccagaucggcgccuucguccucaugaagaugaaggagaccgccgagaacuaccucggccacaccgccaagaacgccgucaucaccguccccgccuacuucaacgacucccagcgccaggccaccaaggacgccggccagaucuccggccucaacguccuccgcgucaucaacgagcccaccgccgccgcccucgccuacggccucgacaaguccgaggacaaggucaucgccgucuacgaccucggcggcggcaccuucgacaucuccauccucgagauccagaagggcgucuucgaggucaaguccaccaacggcgacaccuuccucggcggcgaggacuucgaccaggcccuccuccgccacaucgucaaggaguucaagcgcgagaccggcgucgaccucaccaaggacaacauggcccuccagcgcguccgcgaggccgccgagaaggccaagugcgagcucuccuccuccguccagaccgacaucaaccuccccuaccucaccauggacuccuccggccccaagcaccucaacaugaagcucacccgcgcccaguucgagggcaucgucaccgaccucauccgccgcaccaucgcccccugccagaaggccaugcaggacgccgaggucuccaaguccgacaucggcgaggucauccucgucggcggcaugacccgcaugcccaagguccagcagaccguccaggaccucuucggccgcgcccccuccaaggccgucaaccccgacgaggccgucgccaucggcgccgccauccagggcggcguccucgccggcgacgucaccgacguccuccuccucgacgucaccccccucucccucggcaucgagacccucggcggcgucuucaccaagcucaucaaccgcaacaccaccauccccaccaagaagucccaggucuucuccaccgccgccgacggccagacccaggucgagaucaaggucugccagggcgagcgcgagauggccggcgacaacaagcuccucggccaguucacccucaucggcaucccccccgccccccgcggcgucccccagaucgaggucaccuucgacaucgacgccaacggcaucguccacgucuccgccaaggacaagggcaccggccgcgagcagcagaucgucauccaguccuccggcggccucuccaaggacgacaucgagaacauggucaagaacgccgagaaguacgccgaggaggaccgccgcaagaaggagcgcgucgaggccgucaacauggccgagggcaucauccacgacaccgagaccaagauggaggaguucaaggaccagcuccccgccgacgagugcaacaagcucaaggaggagaucuccaagaugcgcgagcuccucgcccgcaaggacuccgagaccggcgagaacauccgccaggccgccuccucccuccagcaggccucccucaagcucuucgagauggccuacaagaagauggccuccgagcgcgagggcuccggcuccuccggcaccggcgagcagaaggaggaccagaaggaggagaagcagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6468 - RNA, 2304 nt, Artificial Sequence
  mRNA product Design5 comprising derived and/or modified sequence from Homo sapiens__NP_079291.2__HsHSPA12A (opt2)
gggagagucccgcagucggcguccagcggcucugcuuguucgugugugugucguugcaggccuuauucaagcuuaccauggccgacaaggaggccggcggcuccgacggcccccgcgagaccgcccccaccuccgccuacuccucccccgcccgcucccucggcgacaccggcaucaccccccucucccccucccacaucgucaacgacaccgacuccaacgucuccgagcagcaguccuuccucgucgucgucgccgucgacuucggcaccaccuccuccggcuacgccuacuccuucaccaaggagcccgagugcauccacgucaugcgccgcugggagggcggcgaccccggcgucuccaaccagaagacccccaccaccauccuccucacccccgagcgcaaguuccacuccuucggcuacgccgcccgcgacuucuaccacgaccucgaccccaacgaggccaagcaguggcucuaccucgagaaguucaagaugaagcuccacaccaccggcgaccucaccauggacaccgaccucaccgccgccaacggcaagaaggucaaggcccucgagaucuucgccuacgcccuccaguacuucaaggagcaggcccucaaggagcucuccgaccaggccggcuccgaguucgagaacuccgacguccgcugggucaucaccguccccgccaucuggaagcagcccgccaagcaguucaugcgccaggccgccuaccaggccggccucgccucccccgagaacuccgagcagcucaucaucgcccucgagcccgaggccgccuccaucuacugccgcaagcuccgccuccaccagaugaucgagcucuccuccaaggccgccgucaacggcuacuccggcuccgacaccgucggcgccggcuucacccaggccaaggagcacauccgccgcaaccgccagucccgcaccuuccucgucgagaacgucaucggcgagaucugguccgagcucgaggagggcgacaaguacgucgucgucgacuccggcggcggcaccgucgaccucaccguccaccagauccgccuccccgagggccaccucaaggagcucuacaaggccaccggcggccccuacggcucccucggcgucgacuacgaguucgagaagcuccucuacaagaucuucggcgaggacuucaucgagcaguucaagaucaagcgccccgccgccugggucgaccucaugaucgccuucgagucccgcaagcgcgccgccgcccccgaccgcaccaacccccucaacaucacccuccccuucuccuucaucgacuacuacaagaaguuccgcggccacuccgucgagcacgcccuccgcaaguccaacgucgacuucgucaagugguccucccagggcaugcuccgcaugucccccgacgccaugaacgcccucuucaagcccaccaucgacuccaucaucgagcaccuccgcgaccucuuccagaagcccgaggucuccaccgucaaguuccucuuccucgucggcggcuucgccgaggccccccuccuccagcaggccguccaggccgccuucggcgaccagugccgcaucaucaucccccaggacgucggccucaccauccucaagggcgccguccucuucggccucgaccccgccgucaucaagguccgccgcuccccccucaccuacggcgucggcguccucaaccgcuacgucgagggcaagcacccccccgagaagcuccucgucaaggacggcacccgcuggugcaccgacgucuucgacaaguucaucuccgccgaccaguccgucgcccucggcgagcucgucaagcgcuccuacacccccgccaagcccucccagcucgucaucgucaucaacaucuacuccuccgagcacgacaacgucuccuucaucaccgaccccggcgucaagaagugcggcacccuccgccucgaccucaccggcaccuccggcaccgccguccccgcccgccgcgagauccagacccucaugcaguucggcgacaccgagaucaaggccaccgccaucgacaucgccaccuccaaguccgucaaggucggcaucgacuuccucaacuacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6469 - RNA, 2337 nt, Artificial Sequence
  mRNA product Design5 comprising derived and/or modified sequence from Homo sapiens__NP_443202.3 __HsHSPA12B (opt2)
gggagagucccgcagucggcguccagcggcucugcuuguucgugugugugucguugcaggccuuauucaagcuuaccaugcucgccguccccgagaugggccuccagggccucuacaucggcuccucccccgagcgcucccccguccccuccccccccggcuccccccgcacccaggaguccugcggcaucgccccccucacccccucccagucccccaagcccgagguccgcgccccccagcaggccuccuucuccgucgucgucgccaucgacuucggcaccaccuccuccggcuacgccuucuccuucgccuccgaccccgaggccauccacaugaugcgcaagugggagggcggcgaccccggcgucgcccaccagaagacccccaccugccuccuccucacccccgagggcgccuuccacuccuucggcuacaccgcccgcgacuacuaccacgaccucgaccccgaggaggcccgcgacuggcucuacuucgagaaguucaagaugaagauccacuccgccaccgaccucacccucaagacccagcucgaggccgucaacggcaagaccaugcccgcccucgaggucuucgcccacgcccuccgcuucuuccgcgagcacgcccuccaggagcuccgcgagcagucccccucccuccccgagaaggacaccguccgcuggguccucaccguccccgccaucuggaagcagcccgccaagcaguucaugcgcgaggccgccuaccucgccggccucgucucccgcgagaacgccgagcagcuccucaucgcccucgagcccgaggccgccuccgucuacugccgcaagcuccgccuccaccagcuccucgaccucuccggccgcgcccccggcggcggccgccucggcgagcgccgcuccaucgacuccuccuuccgccaggcccgcgagcagcuccgccgcucccgccacucccgcaccuuccucgucgaguccggcgucggcgagcucugggccgagaugcaggccggcgaccgcuacgucgucgccgacugcggcggcggcaccgucgaccucaccguccaccagcucgagcagccccacggcacccucaaggagcucuacaaggccuccggcggccccuacggcgccgucggcgucgaccucgccuucgagcagcuccucugccgcaucuucggcgaggacuucaucgccaccuucaagcgccagcgccccgccgccugggucgaccucaccaucgccuucgaggcccgcaagcgcaccgccggcccccaccgcgccggcgcccucaacaucucccuccccuucuccuucaucgacuucuaccgcaagcagcgcggccacaacgucgagaccgcccuccgccgcuccuccgucaacuucgucaagugguccucccagggcaugcuccgcauguccugcgaggccaugaacgagcucuuccagcccaccgucuccggcaucauccagcacaucgaggcccuccucgcccgccccgagguccagggcgucaagcuccucuuccucgucggcggcuucgccgaguccgccguccuccagcacgccguccaggccgcccucggcgcccgcggccuccgcgucgucgucccccacgacgucggccucaccauccucaagggcgccguccucuucggccaggcccccggcgucguccgcguccgccgcuccccccucaccuacggcgucggcguccucaaccgcuucguccccggccgccacccccccgagaagcuccucguccgcgacggccgccgcuggugcaccgacgucuucgagcgcuucgucgccgccgagcaguccgucgcccucggcgaggagguccgccgcuccuacugccccgcccgccccggccagcgccgcguccucaucaaccucuacugcugcgccgccgaggacgcccgcuucaucaccgaccccggcguccgcaagugcggcgcccucucccucgagcucgagcccgccgacugcggccaggacaccgccggcgccccccccggccgccgcgagauccgcgccgccaugcaguucggcgacaccgagaucaaggucaccgccgucgacgucuccaccaaccgcuccguccgcgccuccaucgacuuccucuccaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6470 - RNA, 1692 nt, Artificial Sequence
  mRNA product Design5 comprising derived and/or modified sequence from Homo sapiens__NP_008879.3__HsHSPA13 (opt2)
gggagagucccgcagucggcguccagcggcucugcuuguucgugugugugucguugcaggccuuauucaagcuuaccauggcccgcgagaugaccauccucggcuccgccguccucacccuccuccucgccggcuaccucgcccagcaguaccucccccuccccacccccaaggucaucggcaucgaccucggcaccaccuacugcuccgucggcgucuucuuccccggcaccggcaaggucaaggucauccccgacgagaacggccacaucuccauccccuccauggucuccuucaccgacaacgacgucuacgucggcuacgaguccgucgagcucgccgacuccaacccccagaacaccaucuacgacgccaagcgcuucaucggcaagaucuucaccgccgaggagcucgaggccgagaucggccgcuaccccuucaagguccucaacaagaacggcauggucgaguucuccgucaccuccaacgagaccaucaccgucucccccgaguacgucggcucccgccuccuccucaagcucaaggagauggccgaggccuaccucggcaugcccgucgccaacgccgucaucuccguccccgccgaguucgaccucaagcagcgcaacuccaccaucgaggccgccaaccucgccggccucaagauccuccgcgucaucaacgagcccaccgccgccgccauggccuacggccuccacaaggccgacgucuuccacguccucgucaucgaccucggcggcggcacccucgacgucucccuccucaacaagcagggcggcauguuccucacccgcgccauguccggcaacaacaagcucggcggccaggacuucaaccagcgccuccuccaguaccucuacaagcagaucuaccagaccuacggcuucguccccucccgcaaggaggagauccaccgccuccgccaggccgucgagauggucaagcucaaccucacccuccaccaguccgcccagcucuccguccuccucaccgucgaggagcaggaccgcaaggagccccacuccuccgacaccgagcuccccaaggacaagcucuccuccgccgacgaccaccgcgucaacuccggcuucggccgcggccucuccgacaagaaguccggcgagucccagguccucuucgagaccgagaucucccgcaagcucuucgacacccucaacgaggaccucuuccagaagauccucguccccauccagcagguccucaaggagggccaccucgagaagaccgagaucgacgaggucguccucgucggcggcuccacccgcaucccccgcauccgccaggucauccaggaguucuucggcaaggaccccaacaccuccgucgaccccgaccucgccgucgucaccggcgucgccauccaggccggcaucgacggcggcuccuggccccuccaggucuccgcccucgagauccccaacaagcaccuccagaagaccaacuucaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6471 - RNA, 1806 nt, Artificial Sequence
  mRNA product Design5 comprising derived and/or modified sequence from Homo sapiens__NP_057383.2__HsHSPA14 (opt2)
gggagagucccgcagucggcguccagcggcucugcuuguucgugugugugucguugcaggccuuauucaagcuuaccauggccgccaucggcguccaccucggcugcaccuccgccugcgucgccgucuacaaggacggccgcgccggcgucgucgccaacgacgccggcgaccgcgucacccccgccgucgucgccuacuccgagaacgaggagaucgucggccucgccgccaagcagucccgcauccgcaacaucuccaacaccgucaugaaggucaagcagauccucggccgcuccuccuccgacccccaggcccagaaguacaucgccgaguccaagugccucgucaucgagaagaacggcaagcuccgcuacgagaucgacaccggcgaggagaccaaguucgucaaccccgaggacgucgcccgccucaucuucuccaagaugaaggagaccgcccacuccguccucggcuccgacgccaacgacgucgucaucaccguccccuucgacuucggcgagaagcagaagaacgcccucggcgaggccgcccgcgccgccggcuucaacguccuccgccucauccacgagcccuccgccgcccuccucgccuacggcaucggccaggacucccccaccggcaaguccaacauccucgucuucaagcucggcggcaccucccucucccucuccgucauggaggucaacuccggcaucuaccgcguccucuccaccaacaccgacgacaacaucggcggcgcccacuucaccgagacccucgcccaguaccucgccuccgaguuccagcgcuccuucaagcacgacguccgcggcaacgcccgcgccaugaugaagcucaccaacuccgccgaggucgccaagcacucccucuccacccucggcuccgccaacugcuuccucgacucccucuacgagggccaggacuucgacugcaacgucucccgcgcccgcuucgagcuccucugcuccccccucuucaacaagugcaucgaggccauccgcggccuccucgaccagaacggcuucaccgccgacgacaucaacaaggucguccucugcggcggcuccucccgcauccccaagcuccagcagcucaucaaggaccucuuccccgccgucgagcuccucaacuccaucccccccgacgaggucauccccaucggcgccgccaucgaggccggcauccucaucggcaaggagaaccuccucgucgaggacucccucaugaucgagugcuccgcccgcgacauccucgucaagggcgucgacgaguccggcgccucccgcuucaccguccucuuccccuccggcaccccccuccccgcccgccgccagcacacccuccaggcccccggcuccaucuccuccgucugccucgagcucuacgaguccgacggcaagaacuccgccaaggaggagaccaaguucgcccaggucguccuccaggaccucgacaagaaggagaacggccuccgcgacauccucgccguccucaccaugaagcgcgacggcucccuccacgucaccugcaccgaccaggagaccggcaagugcgaggccaucuccaucgagaucgccuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6472 - RNA, 2853 nt, Artificial Sequence
  mRNA product Design5 comprising derived and/or modified sequence from Homo sapiens__NP_006635.2 __HsHSPH1 (opt2)
gggagagucccgcagucggcguccagcggcucugcuuguucgugugugugucguugcaggccuuauucaagcuuaccauguccgucgucggccucgacgucggcucccaguccugcuacaucgccgucgcccgcgccggcggcaucgagaccaucgccaacgaguucuccgaccgcugcacccccuccgucaucuccuucggcuccaagaaccgcaccaucggcgucgccgccaagaaccagcagaucacccacgccaacaacaccgucuccaacuucaagcgcuuccacggccgcgccuucaacgaccccuucauccagaaggagaaggagaaccucuccuacgaccucgucccccucaagaacggcggcgucggcaucaaggucauguacaugggcgaggagcaccucuucuccgucgagcagaucaccgccaugcuccucaccaagcucaaggagaccgccgagaacucccucaagaagcccgucaccgacugcgucaucuccguccccuccuucuucaccgacgccgagcgccgcuccguccucgacgccgcccagaucgucggccucaacugccuccgccucaugaacgacaugaccgccgucgcccucaacuacggcaucuacaagcaggaccuccccucccucgacgagaagccccgcaucgucgucuucgucgacaugggccacuccgccuuccaggucuccgccugcgccuucaacaagggcaagcucaagguccucggcaccgccuucgaccccuuccucggcggcaagaacuucgacgagaagcucgucgagcacuucugcgccgaguucaagaccaaguacaagcucgacgccaaguccaagauccgcgcccuccuccgccucuaccaggagugcgagaagcucaagaagcucauguccuccaacuccaccgaccucccccucaacaucgagugcuucaugaacgacaaggacgucuccggcaagaugaaccgcucccaguucgaggagcucugcgccgagcuccuccagaagaucgaggucccccucuacucccuccucgagcagacccaccucaaggucgaggacgucuccgccgucgagaucgucggcggcgccacccgcauccccgccgucaaggagcgcaucgccaaguucuucggcaaggacaucuccaccacccucaacgccgacgaggccgucgcccgcggcugcgcccuccagugcgccauccucucccccgccuucaagguccgcgaguucuccgucaccgacgccguccccuuccccaucucccucaucuggaaccacgacuccgaggacaccgagggcguccacgaggucuucucccgcaaccacgccgcccccuucuccaagguccucaccuuccuccgccgcggccccuucgagcucgaggccuucuacuccgacccccagggcguccccuaccccgaggccaagaucggccgcuucgucguccagaacgucuccgcccagaaggacggcgagaagucccgcgucaaggucaagguccgcgucaacacccacggcaucuucaccaucuccaccgccuccauggucgagaagguccccaccgaggagaacgagauguccuccgaggccgacauggagugccucaaccagcgcccccccgagaaccccgacaccgacaagaacguccagcaggacaacuccgaggccggcacccagccccagguccagaccgacgcccagcagaccucccaguccccccccucccccgagcucaccuccgaggagaacaagauccccgacgccgacaaggccaacgagaagaaggucgaccagccccccgaggccaagaagcccaagaucaaggucgucaacgucgagcuccccaucgaggccaaccucgucuggcagcucggcaaggaccuccucaacauguacaucgagaccgagggcaagaugaucaugcaggacaagcucgagaaggagcgcaacgacgccaagaacgccgucgaggaguacgucuacgaguuccgcgacaagcucugcggccccuacgagaaguucaucugcgagcaggaccaccagaacuuccuccgccuccucaccgagaccgaggacuggcucuacgaggagggcgaggaccaggccaagcaggccuacgucgacaagcucgaggagcucaugaagaucggcacccccgucaagguccgcuuccaggaggccgaggagcgccccaagauguucgaggagcucggccagcgccuccagcacuacgccaagaucgccgccgacuuccgcaacaaggacgagaaguacaaccacaucgacgaguccgagaugaagaaggucgagaaguccgucaacgaggucauggaguggaugaacaacgucaugaacgcccaggccaagaagucccucgaccaggaccccgucguccgcgcccaggagaucaagaccaagaucaaggagcucaacaacaccugcgagcccgucgucacccagcccaagcccaagaucgagucccccaagcucgagcgcacccccaacggccccaacaucgacaagaaggaggaggaccucgaggacaagaacaacuucggcgccgagcccccccaccagaacggcgagugcuaccccaacgagaagaacuccgucaacauggaccucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6473 - RNA, 3276 nt, Artificial Sequence
  mRNA product Design5 comprising derived and/or modified sequence from Homo sapiens__NP_006380.1 __HsHYOU1 (opt2)
gggagagucccgcagucggcguccagcggcucugcuuguucgugugugugucguugcaggccuuauucaagcuuaccauggccgacaagguccgccgccagcgcccccgccgccgcgucugcugggcccucgucgccguccuccucgccgaccuccucgcccucuccgacacccucgccgucauguccgucgaccucggcuccgaguccaugaaggucgccaucgucaagcccggcguccccauggagaucguccucaacaaggagucccgccgcaagacccccgucaucgucacccucaaggagaacgagcgcuucuucggcgacuccgccgccuccauggccaucaagaaccccaaggccacccuccgcuacuuccagcaccuccucggcaagcaggccgacaacccccacgucgcccucuaccaggcccgcuuccccgagcacgagcucaccuucgacccccagcgccagaccguccacuuccagaucuccucccagcuccaguucucccccgaggagguccucggcaugguccucaacuacucccgcucccucgccgaggacuucgccgagcagcccaucaaggacgccgucaucaccguccccgucuucuucaaccaggccgagcgccgcgccguccuccaggccgcccgcauggccggccucaagguccuccagcucaucaacgacaacaccgccaccgcccucuccuacggcgucuuccgccgcaaggacaucaacaccaccgcccagaacaucauguucuacgacaugggcuccggcuccaccgucugcaccaucgucaccuaccagauggucaagaccaaggaggccggcaugcagccccagcuccagauccgcggcgucggcuucgaccgcacccucggcggccucgagauggagcuccgccuccgcgagcgccucgccggccucuucaacgagcagcgcaagggccagcgcgccaaggacguccgcgagaacccccgcgccauggccaagcuccuccgcgaggccaaccgccucaagaccguccucuccgccaacgccgaccacauggcccagaucgagggccucauggacgacgucgacuucaaggccaaggucacccgcgucgaguucgaggagcucugcgccgaccucuucgagcgcguccccggccccguccagcaggcccuccaguccgccgagaugucccucgacgagaucgagcaggucauccucgucggcggcgccacccgcgucccccgcguccaggagguccuccucaaggccgucggcaaggaggagcucggcaagaacaucaacgccgacgaggccgccgccaugggcgccgucuaccaggccgccgcccucuccaaggccuucaaggucaagcccuucgucguccgcgacgccgucgucuaccccauccucgucgaguucacccgcgaggucgaggaggagcccggcauccacucccucaagcacaacaagcgcguccucuucucccgcaugggccccuacccccagcgcaaggucaucaccuucaaccgcuacucccacgacuucaacuuccacaucaacuacggcgaccucggcuuccucggccccgaggaccuccgcgucuucggcucccagaaccucaccaccgucaagcucaagggcgucggcgacuccuucaagaaguaccccgacuacgaguccaagggcaucaaggcccacuucaaccucgacgaguccggcguccucucccucgaccgcgucgaguccgucuucgagacccucgucgaggacuccgccgaggaggaguccacccucaccaagcucggcaacaccaucuccucccucuucggcggcggcaccacccccgacgccaaggagaacggcaccgacaccguccaggaggaggaggagucccccgccgagggcuccaaggacgagcccggcgagcaggucgagcucaaggaggaggccgaggcccccgucgaggacggcucccagccccccccccccgagcccaagggcgacgccacccccgagggcgagaaggccaccgagaaggagaacggcgacaaguccgaggcccagaagcccuccgagaaggccgaggccggccccgagggcgucgcccccgcccccgagggcgagaagaagcagaagcccgcccgcaagcgccgcauggucgaggagaucggcgucgagcucgucguccucgaccuccccgaccuccccgaggacaagcucgcccaguccguccagaagcuccaggaccucacccuccgcgaccucgagaagcaggagcgcgagaaggccgccaacucccucgaggccuucaucuucgagacccaggacaagcucuaccagcccgaguaccaggaggucuccaccgaggagcagcgcgaggagaucuccggcaagcucuccgccgccuccaccuggcucgaggacgagggcgucggcgccaccaccgucaugcucaaggagaagcucgccgagcuccgcaagcucugccagggccucuucuuccgcgucgaggagcgcaagaaguggcccgagcgccucuccgcccucgacaaccuccucaaccacuccuccauguuccucaagggcgcccgccucauccccgagauggaccagaucuucaccgaggucgagaugaccacccucgagaaggucaucaacgagaccugggccuggaagaacgccacccucgccgagcaggccaagcuccccgccaccgagaagcccguccuccucuccaaggacaucgaggccaagaugauggcccucgaccgcgagguccaguaccuccucaacaaggccaaguucaccaagccccgcccccgccccaaggacaagaacggcacccgcgccgagcccccccucaacgccuccgccuccgaccagggcgagaaggucaucccccccgccggccagaccgaggacgccgagcccaucuccgagcccgagaaggucgagaccggcuccgagcccggcgacaccgagccccucgagcucggcggccccggcgccgagcccgagcagaaggagcaguccaccggccagaagcgcccccucaagaacgacgagcucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6474 - RNA, 2475 nt, Artificial Sequence
  mRNA product Design5 comprising derived and/or modified sequence from Homo sapiens__NP_005339.3 __HsHSP90AA1 (opt2)
gggagagucccgcagucggcguccagcggcucugcuuguucgugugugugucguugcaggccuuauucaagcuuaccaugcccgaggagacccagacccaggaccagcccauggaggaggaggaggucgagaccuucgccuuccaggccgagaucgcccagcucaugucccucaucaucaacaccuucuacuccaacaaggagaucuuccuccgcgagcucaucuccaacuccuccgacgcccucgacaagauccgcuacgagucccucaccgaccccuccaagcucgacuccggcaaggagcuccacaucaaccucauccccaacaagcaggaccgcacccucaccaucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucaccgucaucaccaagcacaacgacgacgagcaguacgccugggaguccuccgccggcggcuccuucaccguccgcaccgacaccggcgagcccaugggccgcggcaccaaggucauccuccaccucaaggaggaccagaccgaguaccucgaggagcgccgcaucaaggagaucgucaagaagcacucccaguucaucggcuaccccaucacccucuucgucgagaaggagcgcgacaaggaggucuccgacgacgaggccgaggagaaggaggacaaggaggaggagaaggagaaggaggagaaggaguccgaggacaagcccgagaucgaggacgucggcuccgacgaggaggaggagaagaaggacggcgacaagaagaagaagaagaagaucaaggagaaguacaucgaccaggaggagcucaacaagaccaagcccaucuggacccgcaaccccgacgacaucaccaacgaggaguacggcgaguucuacaagucccucaccaacgacugggaggaccaccucgccgucaagcacuucuccgucgagggccagcucgaguuccgcgcccuccucuucgucccccgccgcgcccccuucgaccucuucgagaaccgcaagaagaagaacaacaucaagcucuacguccgccgcgucuucaucauggacaacugcgaggagcucauccccgaguaccucaacuucauccgcggcgucgucgacuccgaggaccucccccucaacaucucccgcgagaugcuccagcaguccaagauccucaaggucauccgcaagaaccucgucaagaagugccucgagcucuucaccgagcucgccgaggacaaggagaacuacaagaaguucuacgagcaguucuccaagaacaucaagcucggcauccacgaggacucccagaaccgcaagaagcucuccgagcuccuccgcuacuacaccuccgccuccggcgacgagauggucucccucaaggacuacugcacccgcaugaaggagaaccagaagcacaucuacuacaucaccggcgagaccaaggaccaggucgccaacuccgccuucgucgagcgccuccgcaagcacggccucgaggucaucuacaugaucgagcccaucgacgaguacugcguccagcagcucaaggaguucgagggcaagacccucgucuccgucaccaaggagggccucgagcuccccgaggacgaggaggagaagaagaagcaggaggagaagaagaccaaguucgagaaccucugcaagaucaugaaggacauccucgagaagaaggucgagaaggucgucgucuccaaccgccucgucaccucccccugcugcaucgucaccuccaccuacggcuggaccgccaacauggagcgcaucaugaaggcccaggcccuccgcgacaacuccaccaugggcuacauggccgccaagaagcaccucgagaucaaccccgaccacuccaucaucgagacccuccgccagaaggccgaggccgacaagaacgacaaguccgucaaggaccucgucauccuccucuacgagaccgcccuccucuccuccggcuucucccucgaggacccccagacccacgccaaccgcaucuaccgcaugaucaagcucggccucggcaucgacgaggacgaccccaccgccgacgacaccuccgccgccgucaccgaggagaugcccccccucgagggcgacgacgacaccucccgcauggaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6475 - RNA, 615 nt, Artificial Sequence
  mRNA product Design5 comprising derived and/or modified sequence from Homo sapiens__NG_005218__HsHSP90AA3P (opt2)
gggagagucccgcagucggcguccagcggcucugcuuguucgugugugugucguugcaggccuuauucaagcuuaccauggacuccuccaagcucgacuccggcaagggccuccacaucaaccucguccccaacaagcagaaccagacccucaccaucgucgacacccgcaucggcaugaccaagaccgaccucaucaacaaccucggcaccgucaccaaguccggcaccaaggccuucauggaggcccuccaggccgacgccgacaucuccaugaucggccacuucggcgucggcuucuacuccgccuaccucgucgccaagaaggucaccgucaucuccaagcacaacaacgacgagcaguacaccugggaguccuccgccggcggcuccuucaccguccgcaccgacgagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6476 - RNA, 2451 nt, Artificial Sequence
  mRNA product Design5 comprising derived and/or modified sequence from Homo sapiens__NP_031381.2__HsHSP90AB1 (opt2)
gggagagucccgcagucggcguccagcggcucugcuuguucgugugugugucguugcaggccuuauucaagcuuaccaugcccgaggagguccaccacggcgaggaggaggucgagaccuucgccuuccaggccgagaucgcccagcucaugucccucaucaucaacaccuucuacuccaacaaggagaucuuccuccgcgagcucaucuccaacgccuccgacgcccucgacaagauccgcuacgagucccucaccgaccccuccaagcucgacuccggcaaggagcucaagaucgacaucauccccaacccccaggagcgcacccucacccucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucgucgucaucaccaagcacaacgacgacgagcaguacgccugggaguccuccgccggcggcuccuucaccguccgcgccgaccacggcgagcccaucggccgcggcaccaaggucauccuccaccucaaggaggaccagaccgaguaccucgaggagcgccgcgucaaggaggucgucaagaagcacucccaguucaucggcuaccccaucacccucuaccucgagaaggagcgcgagaaggagaucuccgacgacgaggccgaggaggagaagggcgagaaggaggaggaggacaaggacgacgaggagaagcccaagaucgaggacgucggcuccgacgaggaggacgacuccggcaaggacaagaagaagaagaccaagaagaucaaggagaaguacaucgaccaggaggagcucaacaagaccaagcccaucuggacccgcaaccccgacgacaucacccaggaggaguacggcgaguucuacaagucccucaccaacgacugggaggaccaccucgccgucaagcacuucuccgucgagggccagcucgaguuccgcgcccuccucuucaucccccgccgcgcccccuucgaccucuucgagaacaagaagaagaagaacaacaucaagcucuacguccgccgcgucuucaucauggacuccugcgacgagcucauccccgaguaccucaacuucauccgcggcgucgucgacuccgaggaccucccccucaacaucucccgcgagaugcuccagcaguccaagauccucaaggucauccgcaagaacaucgucaagaagugccucgagcucuucuccgagcucgccgaggacaaggagaacuacaagaaguucuacgaggccuucuccaagaaccucaagcucggcauccacgaggacuccaccaaccgccgccgccucuccgagcuccuccgcuaccacaccucccaguccggcgacgagaugaccucccucuccgaguacgucucccgcaugaaggagacccagaaguccaucuacuacaucaccggcgaguccaaggagcaggucgccaacuccgccuucgucgagcgcguccgcaagcgcggcuucgaggucgucuacaugaccgagcccaucgacgaguacugcguccagcagcucaaggaguucgacggcaagucccucgucuccgucaccaaggagggccucgagcuccccgaggacgaggaggagaagaagaagauggaggaguccaaggccaaguucgagaaccucugcaagcucaugaaggagauccucgacaagaaggucgagaaggucaccaucuccaaccgccucgucuccucccccugcugcaucgucaccuccaccuacggcuggaccgccaacauggagcgcaucaugaaggcccaggcccuccgcgacaacuccaccaugggcuacaugauggccaagaagcaccucgagaucaaccccgaccaccccaucgucgagacccuccgccagaaggccgaggccgacaagaacgacaaggccgucaaggaccucgucguccuccucuucgagaccgcccuccucuccuccggcuucucccucgaggacccccagacccacuccaaccgcaucuaccgcaugaucaagcucggccucggcaucgacgaggacgaggucgccgccgaggagcccaacgccgccguccccgacgagauccccccccucgagggcgacgaggacgccucccgcauggaggaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6477 - RNA, 2688 nt, Artificial Sequence
  mRNA product Design5 comprising derived and/or modified sequence from Homo sapiens__NP_003290.1__HsHSP90B1 (opt2)
gggagagucccgcagucggcguccagcggcucugcuuguucgugugugugucguugcaggccuuauucaagcuuaccaugcgcgcccucuggguccucggccucugcugcguccuccucaccuucggcuccguccgcgccgacgacgaggucgacgucgacggcaccgucgaggaggaccucggcaagucccgcgagggcucccgcaccgacgacgaggucguccagcgcgaggaggaggccauccagcucgacggccucaacgccucccagauccgcgagcuccgcgagaaguccgagaaguucgccuuccaggccgaggucaaccgcaugaugaagcucaucaucaacucccucuacaagaacaaggagaucuuccuccgcgagcucaucuccaacgccuccgacgcccucgacaagauccgccucaucucccucaccgacgagaacgcccucuccggcaacgaggagcucaccgucaagaucaagugcgacaaggagaagaaccuccuccacgucaccgacaccggcgucggcaugacccgcgaggagcucgucaagaaccucggcaccaucgccaaguccggcaccuccgaguuccucaacaagaugaccgaggcccaggaggacggccaguccaccuccgagcucaucggccaguucggcgucggcuucuacuccgccuuccucgucgccgacaaggucaucgucaccuccaagcacaacaacgacacccagcacaucugggaguccgacuccaacgaguucuccgucaucgccgacccccgcggcaacacccucggccgcggcaccaccaucacccucguccucaaggaggaggccuccgacuaccucgagcucgacaccaucaagaaccucgucaagaaguacucccaguucaucaacuuccccaucuacgucugguccuccaagaccgagaccgucgaggagcccauggaggaggaggaggccgccaaggaggagaaggaggaguccgacgacgaggccgccgucgaggaggaggaggaggagaagaagcccaagaccaagaaggucgagaagaccgucugggacugggagcucaugaacgacaucaagcccaucuggcagcgccccuccaaggaggucgaggaggacgaguacaaggccuucuacaaguccuucuccaaggaguccgacgaccccauggccuacauccacuucaccgccgagggcgaggucaccuucaaguccauccucuucguccccaccuccgccccccgcggccucuucgacgaguacggcuccaagaaguccgacuacaucaagcucuacguccgccgcgucuucaucaccgacgacuuccacgacaugaugcccaaguaccucaacuucgucaagggcgucgucgacuccgacgaccucccccucaacgucucccgcgagacccuccagcagcacaagcuccucaaggucauccgcaagaagcucguccgcaagacccucgacaugaucaagaagaucgccgacgacaaguacaacgacaccuucuggaaggaguucggcaccaacaucaagcucggcgucaucgaggaccacuccaaccgcacccgccucgccaagcuccuccgcuuccaguccucccaccaccccaccgacaucaccucccucgaccaguacgucgagcgcaugaaggagaagcaggacaagaucuacuucauggccggcuccucccgcaaggaggccgaguccucccccuucgucgagcgccuccucaagaagggcuacgaggucaucuaccucaccgagcccgucgacgaguacugcauccaggcccuccccgaguucgacggcaagcgcuuccagaacgucgccaaggagggcgucaaguucgacgaguccgagaagaccaaggagucccgcgaggccgucgagaaggaguucgagccccuccucaacuggaugaaggacaaggcccucaaggacaagaucgagaaggccgucgucucccagcgccucaccgagucccccugcgcccucgucgccucccaguacggcugguccggcaacauggagcgcaucaugaaggcccaggccuaccagaccggcaaggacaucuccaccaacuacuacgccucccagaagaagaccuucgagaucaacccccgccacccccucauccgcgacaugcuccgccgcaucaaggaggacgaggacgacaagaccguccucgaccucgccgucguccucuucgagaccgccacccuccgcuccggcuaccuccuccccgacaccaaggccuacggcgaccgcaucgagcgcaugcuccgccucucccucaacaucgaccccgacgccaaggucgaggaggagcccgaggaggagcccgaggagaccgccgaggacaccaccgaggacaccgagcaggacgaggacgaggagauggacgucggcaccgacgaggaggaggagaccgccaaggaguccaccgccgagaaggacgagcucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6478 - RNA, 2391 nt, Artificial Sequence
  mRNA product Design5 comprising derived and/or modified sequence from Homo sapiens__NP_057376.2__HsTRAP1 (opt2)
gggagagucccgcagucggcguccagcggcucugcuuguucgugugugugucguugcaggccuuauucaagcuuaccauggcccgcgagcuccgcgcccuccuccucuggggccgccgccuccgcccccuccuccgcgcccccgcccucgccgccguccccggcggcaagcccauccucugcccccgccgcaccaccgcccagcucggcccccgccgcaaccccgccuggucccuccaggccggccgccucuucuccacccagaccgccgaggacaaggaggagccccuccacuccaucaucuccuccaccgaguccguccagggcuccaccuccaagcacgaguuccaggccgagaccaagaagcuccucgacaucgucgcccgcucccucuacuccgagaaggaggucuucauccgcgagcucaucuccaacgccuccgacgcccucgagaagcuccgccacaagcucgucuccgacggccaggcccuccccgagauggagauccaccuccagaccaacgccgagaagggcaccaucaccauccaggacaccggcaucggcaugacccaggaggagcucgucuccaaccucggcaccaucgcccgcuccggcuccaaggccuuccucgacgcccuccagaaccaggccgaggccuccuccaagaucaucggccaguucggcgucggcuucuacuccgccuucauggucgccgaccgcgucgaggucuacucccgcuccgccgcccccggcucccucggcuaccaguggcucuccgacggcuccggcgucuucgagaucgccgaggccuccggcguccgcaccggcaccaagaucaucauccaccucaaguccgacugcaaggaguucuccuccgaggcccgcguccgcgacgucgucaccaaguacuccaacuucgucuccuucccccucuaccucaacggccgccgcaugaacacccuccaggccaucuggaugauggaccccaaggacguccgcgaguggcagcacgaggaguucuaccgcuacgucgcccaggcccacgacaagccccgcuacacccuccacuacaagaccgacgccccccucaacauccgcuccaucuucuacguccccgacaugaagcccuccauguucgacgucucccgcgagcucggcuccuccgucgcccucuacucccgcaagguccucauccagaccaaggccaccgacauccuccccaaguggcuccgcuucauccgcggcgucgucgacuccgaggacaucccccucaaccucucccgcgagcuccuccaggaguccgcccucauccgcaagcuccgcgacguccuccagcagcgccucaucaaguucuucaucgaccaguccaagaaggacgccgagaaguacgccaaguucuucgaggacuacggccucuucaugcgcgagggcaucgucaccgccaccgagcaggaggucaaggaggacaucgccaagcuccuccgcuacgaguccuccgcccuccccuccggccagcucaccucccucuccgaguacgccucccgcaugcgcgccggcacccgcaacaucuacuaccucugcgcccccaaccgccaccucgccgagcacucccccuacuacgaggccaugaagaagaaggacaccgagguccucuucugcuucgagcaguucgacgagcucacccuccuccaccuccgcgaguucgacaagaagaagcucaucuccgucgagaccgacaucgucgucgaccacuacaaggaggagaaguucgaggaccgcucccccgccgccgagugccucuccgagaaggagaccgaggagcucauggccuggaugcgcaacguccucggcucccgcgucaccaacgucaaggucacccuccgccucgacacccaccccgccauggucaccguccucgagaugggcgccgcccgccacuuccuccgcaugcagcagcucgccaagacccaggaggagcgcgcccagcuccuccagcccacccucgagaucaacccccgccacgcccucaucaagaagcucaaccagcuccgcgccuccgagcccggccucgcccagcuccucgucgaccagaucuacgagaacgccaugaucgccgccggccucgucgacgacccccgcgccauggucggccgccucaacgagcuccucgucaaggcccucgagcgccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6479 - RNA, 738 nt, Artificial Sequence
  mRNA product Design5 comprising derived and/or modified sequence from Homo sapiens__NP_000609.1__HsIGF1 (opt2)
gggagagucccgcagucggcguccagcggcucugcuuguucgugugugugucguugcaggccuuauucaagcuuaccaugggcaagaucuccucccuccccacccagcucuucaagugcugcuucugcgacuuccucaaggucaagaugcacaccauguccuccucccaccucuucuaccucgcccucugccuccucaccuucaccuccuccgccaccgccggccccgagacccucugcggcgccgagcucgucgacgcccuccaguucgucugcggcgaccgcggcuucuacuucaacaagcccaccggcuacggcuccuccucccgccgcgccccccagaccggcaucgucgacgagugcugcuuccgcuccugcgaccuccgccgccucgagauguacugcgccccccucaagcccgccaaguccgcccgcuccguccgcgcccagcgccacaccgacaugcccaagacccagaaggagguccaccucaagaacgccucccgcggcuccgccggcaacaagaacuaccgcaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6480 - RNA, 819 nt, Artificial Sequence
  mRNA product Design5 comprising derived and/or modified sequence from Homo sapiens__NP_000603.1__HsIGF2 (opt2)
gggagagucccgcagucggcguccagcggcucugcuuguucgugugugugucguugcaggccuuauucaagcuuaccaugggcauccccaugggcaaguccaugcucguccuccucaccuuccucgccuucgccuccugcugcaucgccgccuaccgccccuccgagacccucugcggcggcgagcucgucgacacccuccaguucgucugcggcgaccgcggcuucuacuucucccgccccgccucccgcgucucccgccgcucccgcggcaucgucgaggagugcugcuuccgcuccugcgaccucgcccuccucgagaccuacugcgccacccccgccaaguccgagcgcgacgucuccaccccccccaccguccuccccgacaacuucccccgcuaccccgucggcaaguucuuccaguacgacaccuggaagcaguccacccagcgccuccgccgcggccuccccgcccuccuccgcgcccgccgcggccacguccucgccaaggagcucgaggccuuccgcgaggccaagcgccaccgcccccucaucgcccuccccacccaggaccccgcccacggcggcgccccccccgagauggccuccaaccgcaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6481 - RNA, 915 nt, Artificial Sequence
  mRNA product Design5 comprising derived and/or modified sequence from Homo sapiens__NP_000591.1__HsIL6 (opt2)
gggagagucccgcagucggcguccagcggcucugcuuguucgugugugugucguugcaggccuuauucaagcuuaccaugaacuccuucuccaccuccgccuucggccccgucgccuucucccucggccuccuccucguccuccccgccgccuuccccgcccccgucccccccggcgaggacuccaaggacgucgccgccccccaccgccagccccucaccuccuccgagcgcaucgacaagcagauccgcuacauccucgacggcaucuccgcccuccgcaaggagaccugcaacaaguccaacaugugcgaguccuccaaggaggcccucgccgagaacaaccucaaccuccccaagauggccgagaaggacggcugcuuccaguccggcuucaacgaggagaccugccucgucaagaucaucaccggccuccucgaguucgaggucuaccucgaguaccuccagaaccgcuucgaguccuccgaggagcaggcccgcgccguccagauguccaccaagguccucauccaguuccuccagaagaaggccaagaaccucgacgccaucaccacccccgaccccaccaccaacgccucccuccucaccaagcuccaggcccagaaccaguggcuccaggacaugaccacccaccucauccuccgcuccuucaaggaguuccuccaguccucccuccgcgcccuccgccagaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6482 - RNA, 1557 nt, Artificial Sequence
  mRNA product Design5 comprising derived and/or modified sequence from Homo sapiens__NP_002183.1__HsINHBA (opt2)
gggagagucccgcagucggcguccagcggcucugcuuguucgugugugugucguugcaggccuuauucaagcuuaccaugccccuccucuggcuccgcggcuuccuccucgccuccugcuggaucaucguccgcuccucccccacccccggcuccgagggccacuccgccgcccccgacugccccuccugcgcccucgccgcccuccccaaggacguccccaacucccagcccgagauggucgaggccgucaagaagcacauccucaacaugcuccaccucaagaagcgccccgacgucacccagcccguccccaaggccgcccuccucaacgccauccgcaagcuccacgucggcaaggucggcgagaacggcuacgucgagaucgaggacgacaucggccgccgcgccgagaugaacgagcucauggagcagaccuccgagaucaucaccuucgccgaguccggcaccgcccgcaagacccuccacuucgagaucuccaaggagggcuccgaccucuccgucgucgagcgcgccgaggucuggcucuuccucaagguccccaaggccaaccgcacccgcaccaaggucaccauccgccucuuccagcagcagaagcacccccagggcucccucgacaccggcgaggaggccgaggaggucggccucaagggcgagcgcuccgagcuccuccucuccgagaaggucgucgacgcccgcaaguccaccuggcacgucuuccccgucuccuccuccauccagcgccuccucgaccagggcaaguccucccucgacguccgcaucgccugcgagcagugccaggaguccggcgccucccucguccuccucggcaagaagaagaagaaggaggaggagggcgagggcaagaagaagggcggcggcgagggcggcgccggcgccgacgaggagaaggagcagucccaccgccccuuccucaugcuccaggcccgccaguccgaggaccacccccaccgccgccgccgccgcggccucgagugcgacggcaaggucaacaucugcugcaagaagcaguucuucgucuccuucaaggacaucggcuggaacgacuggaucaucgcccccuccggcuaccacgccaacuacugcgagggcgagugccccucccacaucgccggcaccuccggcuccucccucuccuuccacuccaccgucaucaaccacuaccgcaugcgcggccacucccccuucgccaaccucaaguccugcugcguccccaccaagcuccgccccauguccaugcucuacuacgacgacggccagaacaucaucaagaaggacauccagaacaugaucgucgaggagugcggcugcuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6483 - RNA, 1500 nt, Artificial Sequence
  mRNA product Design5 comprising derived and/or modified sequence from Homo sapiens__NP_002184.2__HsINHBB (opt2)
gggagagucccgcagucggcguccagcggcucugcuuguucgugugugugucguugcaggccuuauucaagcuuaccauggacggccuccccggccgcgcccucggcgccgccugccuccuccuccucgccgccggcuggcucggccccgaggccuggggcucccccacccccccccccacccccgccgcccccccccccccccccccccccggcucccccggcggcucccaggacaccugcaccuccugcggcggcuuccgccgccccgaggagcucggccgcgucgacggcgacuuccucgaggccgucaagcgccacauccucucccgccuccagaugcgcggccgccccaacaucacccacgccguccccaaggccgccauggucaccgcccuccgcaagcuccacgccggcaagguccgcgaggacggccgcgucgagaucccccaccucgacggccacgccucccccggcgccgacggccaggagcgcgucuccgagaucaucuccuucgccgagaccgacggccucgccuccucccgcguccgccucuacuucuucaucuccaacgagggcaaccagaaccucuucgucguccaggccucccucuggcucuaccucaagcuccuccccuacguccucgagaagggcucccgccgcaagguccgcgucaaggucuacuuccaggagcagggccacggcgaccgcuggaacauggucgagaagcgcgucgaccucaagcgcuccggcuggcacaccuucccccucaccgaggccauccaggcccucuucgagcgcggcgagcgccgccucaaccucgacguccagugcgacuccugccaggagcucgccgucguccccgucuucgucgaccccggcgaggagucccaccgccccuucgucgucguccaggcccgccucggcgacucccgccaccgcauccgcaagcgcggccucgagugcgacggccgcaccaaccucugcugccgccagcaguucuucaucgacuuccgccucaucggcuggaacgacuggaucaucgcccccaccggcuacuacggcaacuacugcgagggcuccugccccgccuaccucgccggcguccccggcuccgccuccuccuuccacaccgccgucgucaaccaguaccgcaugcgcggccucaaccccggcaccgucaacuccugcugcauccccaccaagcucuccaccauguccaugcucuacuucgacgacgaguacaacaucgucaagcgcgacguccccaacaugaucgucgaggagugcggcugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6484 - RNA, 3735 nt, Artificial Sequence
  mRNA product Design5 comprising derived and/or modified sequence from Homo sapiens__NP_000623.2__HsITGAM (opt2)
gggagagucccgcagucggcguccagcggcucugcuuguucgugugugugucguugcaggccuuauucaagcuuaccauggcccuccgcguccuccuccucaccgcccucacccucugccacggcuucaaccucgacaccgagaacgccaugaccuuccaggagaacgcccgcggcuucggccaguccgucguccagcuccagggcucccgcgucgucgucggcgccccccaggagaucgucgccgccaaccagcgcggcucccucuaccagugcgacuacuccaccggcuccugcgagcccauccgccuccagguccccgucgaggccgucaacaugucccucggccucucccucgccgccaccaccucccccccccagcuccucgccugcggccccaccguccaccagaccugcuccgagaacaccuacgucaagggccucugcuuccucuucggcuccaaccuccgccagcagccccagaaguuccccgaggcccuccgcggcugcccccaggaggacuccgacaucgccuuccucaucgacggcuccggcuccaucaucccccacgacuuccgccgcaugaaggaguucgucuccaccgucauggagcagcucaagaaguccaagacccucuucucccucaugcaguacuccgaggaguuccgcauccacuucaccuucaaggaguuccagaacaaccccaacccccgcucccucgucaagcccaucacccagcuccucggccgcacccacaccgccaccggcauccgcaaggucguccgcgagcucuucaacaucaccaacggcgcccgcaagaacgccuucaagauccucgucgucaucaccgacggcgagaaguucggcgacccccucggcuacgaggacgucauccccgaggccgaccgcgagggcgucauccgcuacgucaucggcgucggcgacgccuuccgcuccgagaagucccgccaggagcucaacaccaucgccuccaagcccccccgcgaccacgucuuccaggucaacaacuucgaggcccucaagaccauccagaaccagcuccgcgagaagaucuucgccaucgagggcacccagaccggcuccuccuccuccuucgagcacgagaugucccaggagggcuucuccgccgccaucaccuccaacggcccccuccucuccaccgucggcuccuacgacugggccggcggcgucuuccucuacaccuccaaggagaaguccaccuucaucaacaugacccgcgucgacuccgacaugaacgacgccuaccucggcuacgccgccgccaucauccuccgcaaccgcguccagucccucguccucggcgccccccgcuaccagcacaucggccucgucgccauguuccgccagaacaccggcaugugggaguccaacgccaacgucaagggcacccagaucggcgccuacuucggcgccucccucugcuccgucgacgucgacuccaacggcuccaccgaccucguccucaucggcgccccccacuacuacgagcagacccgcggcggccaggucuccgucugcccccucccccgcggccgcgcccgcuggcagugcgacgccguccucuacggcgagcagggccagcccuggggccgcuucggcgccgcccucaccguccucggcgacgucaacggcgacaagcucaccgacgucgccaucggcgcccccggcgaggaggacaaccgcggcgccgucuaccucuuccacggcaccuccggcuccggcaucucccccucccacucccagcgcaucgccggcuccaagcucuccccccgccuccaguacuucggccagucccucuccggcggccaggaccucaccauggacggccucgucgaccucaccgucggcgcccagggccacguccuccuccuccgcucccagcccguccuccgcgucaaggccaucauggaguucaacccccgcgaggucgcccgcaacgucuucgagugcaacgaccaggucgucaagggcaaggaggccggcgagguccgcgucugccuccacguccagaaguccacccgcgaccgccuccgcgagggccagauccaguccgucgucaccuacgaccucgcccucgacuccggccgcccccacucccgcgccgucuucaacgagaccaagaacuccacccgccgccagacccagguccucggccucacccagaccugcgagacccucaagcuccagcuccccaacugcaucgaggaccccgucucccccaucguccuccgccucaacuucucccucgucggcaccccccucuccgccuucggcaaccuccgccccguccucgccgaggacgcccagcgccucuucaccgcccucuuccccuucgagaagaacugcggcaacgacaacaucugccaggacgaccucuccaucaccuucuccuucaugucccucgacugccucgucgucggcggcccccgcgaguucaacgucaccgucaccguccgcaacgacggcgaggacuccuaccgcacccaggucaccuucuucuucccccucgaccucuccuaccgcaaggucuccacccuccagaaccagcgcucccagcgcuccuggcgccucgccugcgaguccgccuccuccaccgaggucuccggcgcccucaaguccaccuccugcuccaucaaccaccccaucuuccccgagaacuccgaggucaccuucaacaucaccuucgacgucgacuccaaggccucccucggcaacaagcuccuccucaaggccaacgucaccuccgagaacaacaugccccgcaccaacaagaccgaguuccagcucgagcuccccgucaaguacgccgucuacauggucgucaccucccacggcgucuccaccaaguaccucaacuucaccgccuccgagaacaccucccgcgucaugcagcaccaguaccaggucuccaaccucggccagcgcucccuccccaucucccucgucuuccucguccccguccgccucaaccagaccgucaucugggaccgcccccaggucaccuucuccgagaaccucuccuccaccugccacaccaaggagcgccuccccucccacuccgacuuccucgccgagcuccgcaaggcccccgucgucaacugcuccaucgccgucugccagcgcauccagugcgacauccccuucuucggcauccaggaggaguucaacgccacccucaagggcaaccucuccuucgacugguacaucaagaccucccacaaccaccuccucaucgucuccaccgccgagauccucuucaacgacuccgucuucacccuccuccccggccagggcgccuucguccgcucccagaccgagaccaaggucgagcccuucgagguccccaacccccucccccucaucgucggcuccuccgucggcggccuccuccuccucgcccucaucaccgccgcccucuacaagcucggcuucuucaagcgccaguacaaggacaugauguccgagggcggcccccccggcgccgagccccagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6485 - RNA, 1680 nt, Artificial Sequence
  mRNA product Design5 comprising derived and/or modified sequence from Homo sapiens__NP_002415.1__HsMMP8 (opt2)
gggagagucccgcagucggcguccagcggcucugcuuguucgugugugugucguugcaggccuuauucaagcuuaccauguucucccucaagacccuccccuuccuccuccuccuccacguccagaucuccaaggccuuccccgucuccuccaaggagaagaacaccaagaccguccaggacuaccucgagaaguucuaccagcuccccuccaaccaguaccaguccacccgcaagaacggcaccaacgucaucgucgagaagcucaaggagaugcagcgcuucuucggccucaacgucaccggcaagcccaacgaggagacccucgacaugaugaagaagccccgcugcggcguccccgacuccggcggcuucaugcucacccccggcaaccccaagugggagcgcaccaaccucaccuaccgcauccgcaacuacaccccccagcucuccgaggccgaggucgagcgcgccaucaaggacgccuucgagcucugguccgucgccuccccccucaucuucacccgcaucucccagggcgaggccgacaucaacaucgccuucuaccagcgcgaccacggcgacaacucccccuucgacggccccaacggcauccucgcccacgccuuccagcccggccagggcaucggcggcgacgcccacuucgacgccgaggagaccuggaccaacaccuccgccaacuacaaccucuuccucgucgccgcccacgaguucggccacucccucggccucgcccacuccuccgaccccggcgcccucauguaccccaacuacgccuuccgcgagaccuccaacuacucccucccccaggacgacaucgacggcauccaggccaucuacggccucuccuccaaccccauccagcccaccggccccuccacccccaagcccugcgaccccucccucaccuucgacgccaucaccacccuccgcggcgagauccucuucuucaaggaccgcuacuucuggcgccgccacccccagcuccagcgcgucgagaugaacuucaucucccucuucuggcccucccuccccaccggcauccaggccgccuacgaggacuucgaccgcgaccucaucuuccucuucaagggcaaccaguacugggcccucuccggcuacgacauccuccagggcuaccccaaggacaucuccaacuacggcuuccccuccuccguccaggccaucgacgccgccgucuucuaccgcuccaagaccuacuucuucgucaacgaccaguucuggcgcuacgacaaccagcgccaguucauggagcccggcuaccccaaguccaucuccggcgccuuccccggcaucgaguccaaggucgacgccgucuuccagcaggagcacuucuuccacgucuucuccggcccccgcuacuacgccuucgaccucaucgcccagcgcgucacccgcgucgcccgcggcaacaaguggcucaacugccgcuacggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6486 - RNA, 2400 nt, Artificial Sequence
  mRNA product Design5 comprising derived and/or modified sequence from Homo sapiens__NP_004985.2__HsMMP9 (opt2)
gggagagucccgcagucggcguccagcggcucugcuuguucgugugugugucguugcaggccuuauucaagcuuaccaugucccucuggcagccccucguccucguccuccucguccucggcugcugcuucgccgccccccgccagcgccaguccacccucguccucuuccccggcgaccuccgcaccaaccucaccgaccgccagcucgccgaggaguaccucuaccgcuacggcuacacccgcgucgccgagaugcgcggcgaguccaagucccucggccccgcccuccuccuccuccagaagcagcucucccuccccgagaccggcgagcucgacuccgccacccucaaggccaugcgcaccccccgcugcggcguccccgaccucggccgcuuccagaccuucgagggcgaccucaaguggcaccaccacaacaucaccuacuggauccagaacuacuccgaggaccucccccgcgccgucaucgacgacgccuucgcccgcgccuucgcccucugguccgccgucaccccccucaccuucacccgcgucuacucccgcgacgccgacaucgucauccaguucggcgucgccgagcacggcgacggcuaccccuucgacggcaaggacggccuccucgcccacgccuucccccccggccccggcauccagggcgacgcccacuucgacgacgacgagcucuggucccucggcaagggcgucgucguccccacccgcuucggcaacgccgacggcgccgccugccacuuccccuucaucuucgagggccgcuccuacuccgccugcaccaccgacggccgcuccgacggccuccccuggugcuccaccaccgccaacuacgacaccgacgaccgcuucggcuucugccccuccgagcgccucuacacccaggacggcaacgccgacggcaagcccugccaguuccccuucaucuuccagggccaguccuacuccgccugcaccaccgacggccgcuccgacggcuaccgcuggugcgccaccaccgccaacuacgaccgcgacaagcucuucggcuucugccccacccgcgccgacuccaccgucaugggcggcaacuccgccggcgagcucugcgucuuccccuucaccuuccucggcaaggaguacuccaccugcaccuccgagggccgcggcgacggccgccucuggugcgccaccaccuccaacuucgacuccgacaagaaguggggcuucugccccgaccagggcuacucccucuuccucgucgccgcccacgaguucggccacgcccucggccucgaccacuccuccguccccgaggcccucauguaccccauguaccgcuucaccgagggccccccccuccacaaggacgacgucaacggcauccgccaccucuacggcccccgccccgagcccgagccccgcccccccaccaccaccaccccccagcccaccgccccccccaccgucugccccaccggcccccccaccguccaccccuccgagcgccccaccgccggccccaccggcccccccuccgccggccccaccggcccccccaccgccggccccuccaccgccaccaccgucccccucucccccgucgacgacgccugcaacgucaacaucuucgacgccaucgccgagaucggcaaccagcucuaccucuucaaggacggcaaguacuggcgcuucuccgagggccgcggcucccgcccccagggccccuuccucaucgccgacaaguggcccgcccucccccgcaagcucgacuccgucuucgaggagcgccucuccaagaagcucuucuucuucuccggccgccaggucugggucuacaccggcgccuccguccucggcccccgccgccucgacaagcucggccucggcgccgacgucgcccaggucaccggcgcccuccgcuccggccgcggcaagaugcuccucuucuccggccgccgccucuggcgcuucgacgucaaggcccagauggucgacccccgcuccgccuccgaggucgaccgcauguuccccggcgucccccucgacacccacgacgucuuccaguaccgcgagaaggccuacuucugccaggaccgcuucuacuggcgcgucuccucccgcuccgagcucaaccaggucgaccaggucggcuacgucaccuacgacauccuccagugccccgaggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6487 - RNA, 1692 nt, Artificial Sequence
  mRNA product Design5 comprising derived and/or modified sequence from Homo sapiens__NP_002418.1__HsMMP13 (opt2)
gggagagucccgcagucggcguccagcggcucugcuuguucgugugugugucguugcaggccuuauucaagcuuaccaugcaccccggcguccucgccgccuuccucuuccucuccuggacccacugccgcgcccucccccuccccuccggcggcgacgaggacgaccucuccgaggaggaccuccaguucgccgagcgcuaccuccgcuccuacuaccaccccaccaaccucgccggcauccucaaggagaacgccgccuccuccaugaccgagcgccuccgcgagaugcaguccuucuucggccucgaggucaccggcaagcucgacgacaacacccucgacgucaugaagaagccccgcugcggcguccccgacgucggcgaguacaacgucuucccccgcacccucaagugguccaagaugaaccucaccuaccgcaucgucaacuacacccccgacaugacccacuccgaggucgagaaggccuucaagaaggccuucaaggucugguccgacgucaccccccucaacuucacccgccuccacgacggcaucgccgacaucaugaucuccuucggcaucaaggagcacggcgacuucuaccccuucgacggccccuccggccuccucgcccacgccuucccccccggccccaacuacggcggcgacgcccacuucgacgacgacgagaccuggaccuccuccuccaagggcuacaaccucuuccucgucgccgcccacgaguucggccacucccucggccucgaccacuccaaggaccccggcgcccucauguuccccaucuacaccuacaccggcaagucccacuucaugcuccccgacgacgacguccagggcauccagucccucuacggccccggcgacgaggaccccaaccccaagcaccccaagacccccgacaagugcgaccccucccucucccucgacgccaucaccucccuccgcggcgagaccaugaucuucaaggaccgcuucuucuggcgccuccacccccagcaggucgacgccgagcucuuccucaccaaguccuucuggcccgagcuccccaaccgcaucgacgccgccuacgagcaccccucccacgaccucaucuucaucuuccgcggccgcaaguucugggcccucaacggcuacgacauccucgagggcuaccccaagaagaucuccgagcucggccuccccaaggaggucaagaagaucuccgccgccguccacuucgaggacaccggcaagacccuccucuucuccggcaaccaggucuggcgcuacgacgacaccaaccacaucauggacaaggacuacccccgccucaucgaggaggacuuccccggcaucggcgacaaggucgacgccgucuacgagaagaacggcuacaucuacuucuucaacggccccauccaguucgaguacuccaucugguccaaccgcaucguccgcgucaugcccgccaacuccauccucuggugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6488 - RNA, 1344 nt, Artificial Sequence
  mRNA product Design5 comprising derived and/or modified sequence from Homo sapiens__NP_001286.1__HsCCR1 (opt2)
gggagagucccgcagucggcguccagcggcucugcuuguucgugugugugucguugcaggccuuauucaagcuuaccauggagacccccaacaccaccgaggacuacgacaccaccaccgaguucgacuacggcgacgccacccccugccagaaggucaacgagcgcgccuucggcgcccagcuccuccccccccucuacucccucgucuucgucaucggccucgucggcaacauccucgucguccucguccucguccaguacaagcgccucaagaacaugaccuccaucuaccuccucaaccucgccaucuccgaccuccucuuccucuucacccuccccuucuggaucgacuacaagcucaaggacgacugggucuucggcgacgccaugugcaagauccucuccggcuucuacuacaccggccucuacuccgagaucuucuucaucauccuccucaccaucgaccgcuaccucgccaucguccacgccgucuucgcccuccgcgcccgcaccgucaccuucggcgucaucaccuccaucaucaucugggcccucgccauccucgccuccaugcccggccucuacuucuccaagacccagugggaguucacccaccacaccugcucccuccacuucccccacgagucccuccgcgaguggaagcucuuccaggcccucaagcucaaccucuucggccucguccucccccuccucgucaugaucaucugcuacaccggcaucaucaagauccuccuccgccgccccaacgagaagaaguccaaggccguccgccucaucuucgucaucaugaucaucuucuuccucuucuggacccccuacaaccucaccauccucaucuccgucuuccaggacuuccucuucacccacgagugcgagcagucccgccaccucgaccucgccguccaggucaccgaggucaucgccuacacccacugcugcgucaaccccgucaucuacgccuucgucggcgagcgcuuccgcaaguaccuccgccagcucuuccaccgccgcgucgccguccaccucgucaaguggcuccccuuccucuccgucgaccgccucgagcgcgucuccuccaccucccccuccaccggcgagcacgagcucuccgccggcuucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6489 - RNA, 912 nt, Artificial Sequence
  mRNA product Design5 comprising derived and/or modified sequence from Homo sapiens__NP_002598.4__HsPDGFA (opt2)
gggagagucccgcagucggcguccagcggcucugcuuguucgugugugugucguugcaggccuuauucaagcuuaccaugcgcacccucgccugccuccuccuccucggcugcggcuaccucgcccacguccucgccgaggaggccgagaucccccgcgaggucaucgagcgccucgcccgcucccagauccacuccauccgcgaccuccagcgccuccucgagaucgacuccgucggcuccgaggacucccucgacaccucccuccgcgcccacggcguccacgccaccaagcacguccccgagaagcgcccccuccccauccgccgcaagcgcuccaucgaggaggccguccccgccgucugcaagacccgcaccgucaucuacgagaucccccgcucccaggucgaccccaccuccgccaacuuccucaucuggccccccugcgucgaggucaagcgcugcaccggcugcugcaacaccuccuccgucaagugccagcccucccgcguccaccaccgcuccgucaaggucgccaaggucgaguacguccgcaagaagcccaagcucaaggagguccagguccgccucgaggagcaccucgagugcgccugcgccaccaccucccucaaccccgacuaccgcgaggaggacaccggccgcccccgcgaguccggcaagaagcgcaagcgcaagcgccucaagcccaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6490 - RNA, 1002 nt, Artificial Sequence
  mRNA product Design5 comprising derived and/or modified sequence from Homo sapiens__NP_002599.1__HsPDGFB (opt2)
gggagagucccgcagucggcguccagcggcucugcuuguucgugugugugucguugcaggccuuauucaagcuuaccaugaaccgcugcugggcccucuuccucucccucugcugcuaccuccgccucgucuccgccgagggcgaccccauccccgaggagcucuacgagaugcucuccgaccacuccauccgcuccuucgacgaccuccagcgccuccuccacggcgaccccggcgaggaggacggcgccgagcucgaccucaacaugacccgcucccacuccggcggcgagcucgagucccucgcccgcggccgccgcucccucggcucccucaccaucgccgagcccgccaugaucgccgagugcaagacccgcaccgaggucuucgagaucucccgccgccucaucgaccgcaccaacgccaacuuccucgucuggccccccugcgucgagguccagcgcugcuccggcugcugcaacaaccgcaacguccagugccgccccacccagguccagcuccgccccguccagguccgcaagaucgagaucguccgcaagaagcccaucuucaagaaggccaccgucacccucgaggaccaccucgccugcaagugcgagaccgucgccgccgcccgccccgucacccgcucccccggcggcucccaggagcagcgcgccaagaccccccagacccgcgucaccauccgcaccguccgcguccgccgcccccccaagggcaagcaccgcaaguucaagcacacccacgacaagaccgcccucaaggagacccucggcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6491 - RNA, 1314 nt, Artificial Sequence
  mRNA product Design5 comprising derived and/or modified sequence from Homo sapiens__NP_057289.1__HsPDGFC (opt2)
gggagagucccgcagucggcguccagcggcucugcuuguucgugugugugucguugcaggccuuauucaagcuuaccaugucccucuucggccuccuccuccucaccuccgcccucgccggccagcgccagggcacccaggccgaguccaaccucuccuccaaguuccaguucuccuccaacaaggagcagaacggcguccaggacccccagcacgagcgcaucaucaccgucuccaccaacggcuccauccacuccccccgcuucccccacaccuacccccgcaacaccguccucgucuggcgccucgucgccgucgaggagaacgucuggauccagcucaccuucgacgagcgcuucggccucgaggaccccgaggacgacaucugcaaguacgacuucgucgaggucgaggagcccuccgacggcaccauccucggccgcuggugcggcuccggcaccguccccggcaagcagaucuccaagggcaaccagauccgcauccgcuucgucuccgacgaguacuuccccuccgagcccggcuucugcauccacuacaacaucgucaugccccaguucaccgaggccgucucccccuccguccucccccccuccgcccucccccucgaccuccucaacaacgccaucaccgccuucuccacccucgaggaccucauccgcuaccucgagcccgagcgcuggcagcucgaccucgaggaccucuaccgccccaccuggcagcuccucggcaaggccuucgucuucggccgcaagucccgcgucgucgaccucaaccuccucaccgaggagguccgccucuacuccugcaccccccgcaacuucuccgucuccauccgcgaggagcucaagcgcaccgacaccaucuucuggcccggcugccuccucgucaagcgcugcggcggcaacugcgccugcugccuccacaacugcaacgagugccagugcguccccuccaaggucaccaagaaguaccacgagguccuccagcuccgccccaagaccggcguccgcggccuccacaagucccucaccgacgucgcccucgagcaccacgaggagugcgacugcgucugccgcggcuccaccggcggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6492 - RNA, 1371 nt, Artificial Sequence
  mRNA product Design5 comprising derived and/or modified sequence from Homo sapiens__NP_149126.1__HsPDGFD (opt2)
gggagagucccgcagucggcguccagcggcucugcuuguucgugugugugucguugcaggccuuauucaagcuuaccaugcaccgccucaucuucgucuacacccucaucugcgccaacuucugcuccugccgcgacaccuccgccaccccccaguccgccuccaucaaggcccuccgcaacgccaaccuccgccgcgacgaccucuaccgccgcgacgagaccauccaggucaagggcaacggcuacguccaguccccccgcuuccccaacuccuacccccgcaaccuccuccucaccuggcgccuccacucccaggagaacacccgcauccagcucgucuucgacaaccaguucggccucgaggaggccgagaacgacaucugccgcuacgacuucgucgaggucgaggacaucuccgagaccuccaccaucauccgcggccgcuggugcggccacaaggagguccccccccgcaucaagucccgcaccaaccagaucaagaucaccuucaaguccgacgacuacuucgucgccaagcccggcuucaagaucuacuacucccuccucgaggacuuccagcccgccgccgccuccgagaccaacugggaguccgucaccuccuccaucuccggcgucuccuacaacucccccuccgucaccgaccccacccucaucgccgacgcccucgacaagaagaucgccgaguucgacaccgucgaggaccuccucaaguacuucaaccccgaguccuggcaggaggaccucgagaacauguaccucgacaccccccgcuaccgcggccgcuccuaccacgaccgcaaguccaaggucgaccucgaccgccucaacgacgacgccaagcgcuacuccugcaccccccgcaacuacuccgucaacauccgcgaggagcucaagcucgccaacgucgucuucuucccccgcugccuccucguccagcgcugcggcggcaacugcggcugcggcaccgucaacuggcgcuccugcaccugcaacuccggcaagaccgucaagaaguaccacgagguccuccaguucgagcccggccacaucaagcgccgcggccgcgccaagaccauggcccucgucgacauccagcucgaccaccacgagcgcugcgacugcaucugcuccucccgccccccccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6493 - RNA, 954 nt, Artificial Sequence
  mRNA product Design5 comprising derived and/or modified sequence from Homo sapiens__NP_003946.3__HsSOCS3 (opt2)
gggagagucccgcagucggcguccagcggcucugcuuguucgugugugugucguugcaggccuuauucaagcuuaccauggucacccacuccaaguuccccgccgccggcaugucccgcccccucgacaccucccuccgccucaagaccuucuccuccaaguccgaguaccagcucgucgucaacgccguccgcaagcuccaggaguccggcuucuacugguccgccgucaccggcggcgaggccaaccuccuccucuccgccgagcccgccggcaccuuccucauccgcgacuccuccgaccagcgccacuucuucacccucuccgucaagacccaguccggcaccaagaaccuccgcauccagugcgagggcggcuccuucucccuccaguccgacccccgcuccacccagcccgucccccgcuucgacugcguccucaagcucguccaccacuacaugcccccccccggcgcccccuccuuccccuccccccccaccgagcccuccuccgagguccccgagcagcccuccgcccagccccuccccggcucccccccccgccgcgccuacuacaucuacuccggcggcgagaagaucccccucguccucucccgcccccucuccuccaacgucgccacccuccagcaccucugccgcaagaccgucaacggccaccucgacuccuacgagaaggucacccagcuccccggccccauccgcgaguuccucgaccaguacgacgccccccucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6494 - RNA, 759 nt, Artificial Sequence
  mRNA product Design5 comprising derived and/or modified sequence from Homo sapiens__NP_003227.1__HsTGFA (opt2)
gggagagucccgcagucggcguccagcggcucugcuuguucgugugugugucguugcaggccuuauucaagcuuaccaugguccccuccgccggccagcucgcccucuucgcccucggcaucguccucgccgccugccaggcccucgagaacuccaccuccccccucuccgccgacccccccgucgccgccgccgucgucucccacuucaacgacugccccgacucccacacccaguucugcuuccacggcaccugccgcuuccucguccaggaggacaagcccgccugcgucugccacuccggcuacgucggcgcccgcugcgagcacgccgaccuccucgccgucgucgccgccucccagaagaagcaggccaucaccgcccucgucgucgucuccaucgucgcccucgccguccucaucaucaccugcguccucauccacugcugccagguccgcaagcacugcgaguggugccgcgcccucaucugccgccacgagaagcccuccgcccuccucaagggccgcaccgccugcugccacuccgagaccgucgucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6495 - RNA, 1449 nt, Artificial Sequence
  mRNA product Design5 comprising derived and/or modified sequence from Homo sapiens__NP_000651.3__HsTGFB1 (opt2)
gggagagucccgcagucggcguccagcggcucugcuuguucgugugugugucguugcaggccuuauucaagcuuaccaugccccccuccggccuccgccuccucccccuccuccucccccuccucuggcuccucguccucacccccggccgccccgccgccggccucuccaccugcaagaccaucgacauggagcucgucaagcgcaagcgcaucgaggccauccgcggccagauccucuccaagcuccgccucgccuccccccccucccagggcgaggucccccccggcccccuccccgaggccguccucgcccucuacaacuccacccgcgaccgcgucgccggcgaguccgccgagcccgagcccgagcccgaggccgacuacuacgccaaggaggucacccgcguccucauggucgagacccacaacgagaucuacgacaaguucaagcaguccacccacuccaucuacauguucuucaacaccuccgagcuccgcgaggccguccccgagcccguccuccucucccgcgccgagcuccgccuccuccgccucaagcucaaggucgagcagcacgucgagcucuaccagaaguacuccaacaacuccuggcgcuaccucuccaaccgccuccucgcccccuccgacucccccgaguggcucuccuucgacgucaccggcgucguccgccaguggcucucccgcggcggcgagaucgagggcuuccgccucuccgcccacugcuccugcgacucccgcgacaacacccuccaggucgacaucaacggcuucaccaccggccgccgcggcgaccucgccaccauccacggcaugaaccgccccuuccuccuccucauggccaccccccucgagcgcgcccagcaccuccaguccucccgccaccgccgcgcccucgacaccaacuacugcuucuccuccaccgagaagaacugcugcguccgccagcucuacaucgacuuccgcaaggaccucggcuggaaguggauccacgagcccaagggcuaccacgccaacuucugccucggccccugccccuacaucuggucccucgacacccaguacuccaagguccucgcccucuacaaccagcacaaccccggcgccuccgccgcccccugcugcgucccccaggcccucgagccccuccccaucgucuacuacgucggccgcaagcccaaggucgagcagcucuccaacaugaucguccgcuccugcaagugcuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6496 - RNA, 1521 nt, Artificial Sequence
  mRNA product Design5 comprising derived and/or modified sequence from Homo sapiens__NP_003229.1__HsTGFB2 (opt2)
gggagagucccgcagucggcguccagcggcucugcuuguucgugugugugucguugcaggccuuauucaagcuuaccaugcacuacugcguccucuccgccuuccucauccuccaccucgucaccgucgcccucucccucuccaccugcuccacccucgacauggaccaguucaugcgcaagcgcaucgaggccauccgcggccagauccucuccaagcucaagcucaccuccccccccgaggacuaccccgagcccgaggaggucccccccgaggucaucuccaucuacaacuccacccgcgaccuccuccaggagaaggccucccgccgcgccgccgccugcgagcgcgagcgcuccgacgaggaguacuacgccaaggaggucuacaagaucgacaugccccccuucuuccccuccgagaacgccaucccccccaccuucuaccgccccuacuuccgcaucguccgcuucgacgucuccgccauggagaagaacgccuccaaccucgucaaggccgaguuccgcgucuuccgccuccagaaccccaaggcccgcguccccgagcagcgcaucgagcucuaccagauccucaaguccaaggaccucaccucccccacccagcgcuacaucgacuccaaggucgucaagacccgcgccgagggcgaguggcucuccuucgacgucaccgacgccguccacgaguggcuccaccacaaggaccgcaaccucggcuucaagaucucccuccacugccccugcugcaccuucguccccuccaacaacuacaucauccccaacaaguccgaggagcucgaggcccgcuucgccggcaucgacggcaccuccaccuacaccuccggcgaccagaagaccaucaaguccacccgcaagaagaacuccggcaagaccccccaccuccuccucaugcuccuccccuccuaccgccucgagucccagcagaccaaccgccgcaagaagcgcgcccucgacgccgccuacugcuuccgcaacguccaggacaacugcugccuccgcccccucuacaucgacuucaagcgcgaccucggcuggaaguggauccacgagcccaagggcuacaacgccaacuucugcgccggcgccugccccuaccucugguccuccgacacccagcacucccgcguccucucccucuacaacaccaucaaccccgaggccuccgccucccccugcugcgucucccaggaccucgagccccucaccauccucuacuacaucggcaagacccccaagaucgagcagcucuccaacaugaucgucaaguccugcaagugcuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6497 - RNA, 1515 nt, Artificial Sequence
  mRNA product Design5 comprising derived and/or modified sequence from Homo sapiens__NP_003230.1__HsTGFB3 (opt2)
gggagagucccgcagucggcguccagcggcucugcuuguucgugugugugucguugcaggccuuauucaagcuuaccaugaagaugcaccuccagcgcgcccucgucguccucgcccuccucaacuucgccaccgucucccucucccucuccaccugcaccacccucgacuucggccacaucaagaagaagcgcgucgaggccauccgcggccagauccucuccaagcuccgccucaccuccccccccgagcccaccgucaugacccacguccccuaccagguccucgcccucuacaacuccacccgcgagcuccucgaggagaugcacggcgagcgcgaggagggcugcacccaggagaacaccgaguccgaguacuacgccaaggagauccacaaguucgacaugauccagggccucgccgagcacaacgagcucgccgucugccccaagggcaucaccuccaaggucuuccgcuucaacgucuccuccgucgagaagaaccgcaccaaccucuuccgcgccgaguuccgcguccuccgcguccccaaccccuccuccaagcgcaacgagcagcgcaucgagcucuuccagauccuccgccccgacgagcacaucgccaagcagcgcuacaucggcggcaagaaccuccccacccgcggcaccgccgaguggcucuccuucgacgucaccgacaccguccgcgaguggcuccuccgccgcgaguccaaccucggccucgagaucuccauccacugccccugccacaccuuccagcccaacggcgacauccucgagaacauccacgaggucauggagaucaaguucaagggcgucgacaacgaggacgaccacggccgcggcgaccucggccgccucaagaagcagaaggaccaccacaacccccaccucauccucaugaugauccccccccaccgccucgacaaccccggccagggcggccagcgcaagaagcgcgcccucgacaccaacuacugcuuccgcaaccucgaggagaacugcugcguccgcccccucuacaucgacuuccgccaggaccucggcuggaaguggguccacgagcccaagggcuacuacgccaacuucugcuccggccccugccccuaccuccgcuccgccgacaccacccacuccaccguccucggccucuacaacacccucaaccccgaggccuccgccucccccugcugcgucccccaggaccucgagccccucaccauccucuacuacgucggccgcacccccaaggucgagcagcucuccaacauggucgucaaguccugcaagugcuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6498 - RNA, 1662 nt, Artificial Sequence
  mRNA product Design5 comprising derived and/or modified sequence from Homo sapiens__NP_001057.1__HsTNFRSF1B (opt2)
gggagagucccgcagucggcguccagcggcucugcuuguucgugugugugucguugcaggccuuauucaagcuuaccauggcccccgucgccgucugggccgcccucgccgucggccucgagcucugggccgccgcccacgcccuccccgcccaggucgccuucacccccuacgcccccgagcccggcuccaccugccgccuccgcgaguacuacgaccagaccgcccagaugugcugcuccaagugcucccccggccagcacgccaaggucuucugcaccaagaccuccgacaccgucugcgacuccugcgaggacuccaccuacacccagcucuggaacuggguccccgagugccucuccugcggcucccgcugcuccuccgaccaggucgagacccaggccugcacccgcgagcagaaccgcaucugcaccugccgccccggcugguacugcgcccucuccaagcaggagggcugccgccucugcgccccccuccgcaagugccgccccggcuucggcgucgcccgccccggcaccgagaccuccgacgucgucugcaagcccugcgcccccggcaccuucuccaacaccaccuccuccaccgacaucugccgcccccaccagaucugcaacgucgucgccauccccggcaacgccuccauggacgccgucugcaccuccaccucccccacccgcuccauggcccccggcgccguccaccucccccagcccgucuccacccgcucccagcacacccagcccacccccgagcccuccaccgcccccuccaccuccuuccuccuccccaugggccccuccccccccgccgagggcuccaccggcgacuucgcccuccccgucggccucaucgucggcgucaccgcccucggccuccucaucaucggcgucgucaacugcgucaucaugacccaggucaagaagaagccccucugccuccagcgcgaggccaaggucccccaccuccccgccgacaaggcccgcggcacccagggccccgagcagcagcaccuccucaucaccgcccccuccuccuccuccuccucccucgaguccuccgccuccgcccucgaccgccgcgcccccacccgcaaccagccccaggcccccggcgucgaggccuccggcgccggcgaggcccgcgccuccaccggcuccuccgacuccucccccggcggccacggcacccaggucaacgucaccugcaucgucaacgucugcuccuccuccgaccacuccucccagugcuccucccaggccuccuccaccaugggcgacaccgacuccucccccuccgagucccccaaggacgagcagguccccuucuccaaggaggagugcgccuuccgcucccagcucgagacccccgagacccuccucggcuccaccgaggagaagccccucccccucggcguccccgacgccggcaugaagcccuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6499 - RNA, 789 nt, Artificial Sequence
  mRNA product Design5 comprising derived and/or modified sequence from Homo sapiens__NP_002623.2__HsPGF (opt2)
gggagagucccgcagucggcguccagcggcucugcuuguucgugugugugucguugcaggccuuauucaagcuuaccaugcccgucaugcgccucuuccccugcuuccuccagcuccucgccggccucgcccuccccgccguccccccccagcagugggcccucuccgccggcaacggcuccuccgaggucgaggucguccccuuccaggaggucuggggccgcuccuacugccgcgcccucgagcgccucgucgacgucgucuccgaguaccccuccgaggucgagcacauguucucccccuccugcgucucccuccuccgcugcaccggcugcugcggcgacgagaaccuccacugcguccccgucgagaccgccaacgucaccaugcagcuccucaagauccgcuccggcgaccgccccuccuacgucgagcucaccuucucccagcacguccgcugcgagugccgcccccuccgcgagaagaugaagcccgagcgccgccgccccaagggccgcggcaagcgccgccgcgagaagcagcgccccaccgacugccaccucugcggcgacgccgucccccgccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6500 - RNA, 1515 nt, Artificial Sequence
  mRNA product Design5 comprising derived and/or modified sequence from Homo sapiens__NP_001020537.2__HsVEGFA (opt2)
gggagagucccgcagucggcguccagcggcucugcuuguucgugugugugucguugcaggccuuauucaagcuuaccaugaccgaccgccagaccgacaccgcccccucccccuccuaccaccuccuccccggccgccgccgcaccgucgacgccgccgccucccgcggccagggccccgagcccgcccccggcggcggcgucgagggcgucggcgcccgcggcgucgcccucaagcucuucguccagcuccucggcugcucccgcuucggcggcgccgucguccgcgccggcgaggccgagcccuccggcgccgcccgcuccgccuccuccggccgcgaggagccccagcccgaggagggcgaggaggaggaggagaaggaggaggagcgcggcccccaguggcgccucggcgcccgcaagcccggcuccuggaccggcgaggccgccgucugcgccgacuccgcccccgccgcccgcgccccccaggcccucgcccgcgccuccggccgcggcggccgcgucgcccgccgcggcgccgaggaguccggccccccccacucccccucccgccgcggcuccgccucccgcgccggccccggccgcgccuccgagaccaugaacuuccuccucuccuggguccacuggucccucgcccuccuccucuaccuccaccacgccaaguggucccaggccgcccccauggccgagggcggcggccagaaccaccacgaggucgucaaguucauggacgucuaccagcgcuccuacugccaccccaucgagacccucgucgacaucuuccaggaguaccccgacgagaucgaguacaucuucaagcccuccugcgucccccucaugcgcugcggcggcugcugcaacgacgagggccucgagugcguccccaccgaggaguccaacaucaccaugcagaucaugcgcaucaagccccaccagggccagcacaucggcgagauguccuuccuccagcacaacaagugcgagugccgccccaagaaggaccgcgcccgccaggagaagaaguccguccgcggcaagggcaagggccagaagcgcaagcgcaagaagucccgcuacaaguccugguccgucuacgucggcgcccgcugcugccucaugcccuggucccuccccggcccccaccccugcggccccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6501 - RNA, 975 nt, Artificial Sequence
  mRNA product Design5 comprising derived and/or modified sequence from Homo sapiens__NP_001165094.1__HsVEGFA (opt2)
gggagagucccgcagucggcguccagcggcucugcuuguucgugugugugucguugcaggccuuauucaagcuuaccaugaacuuccuccucuccuggguccacuggucccucgcccuccuccucuaccuccaccacgccaaguggucccaggccgcccccauggccgagggcggcggccagaaccaccacgaggucgucaaguucauggacgucuaccagcgcuccuacugccaccccaucgagacccucgucgacaucuuccaggaguaccccgacgagaucgaguacaucuucaagcccuccugcgucccccucaugcgcugcggcggcugcugcaacgacgagggccucgagugcguccccaccgaggaguccaacaucaccaugcagaucaugcgcaucaagccccaccagggccagcacaucggcgagauguccuuccuccagcacaacaagugcgagugccgccccaagaaggaccgcgcccgccaggagaagaaguccguccgcggcaagggcaagggccagaagcgcaagcgcaagaagucccgcuacaaguccugguccgucuacgucggcgcccgcugcugccucaugcccuggucccuccccggcccccaccccugcggccccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6502 - RNA, 900 nt, Artificial Sequence
  mRNA product Design5 comprising derived and/or modified sequence from Homo sapiens__NP_003368.1__HsVEGFB (opt2)
gggagagucccgcagucggcguccagcggcucugcuuguucgugugugugucguugcaggccuuauucaagcuuaccauguccccccuccuccgccgccuccuccucgccgcccuccuccagcucgcccccgcccaggcccccgucucccagcccgacgcccccggccaccagcgcaaggucgucuccuggaucgacgucuacacccgcgccaccugccagccccgcgaggucgucgucccccucaccgucgagcucaugggcaccgucgccaagcagcucguccccuccugcgucaccguccagcgcugcggcggcugcugccccgacgacggccucgagugcguccccaccggccagcaccagguccgcaugcagauccucaugauccgcuaccccuccucccagcucggcgagaugucccucgaggagcacucccagugcgagugccgccccaagaagaaggacuccgccgucaagcccgaccgcgccgccaccccccaccaccgcccccagccccgcuccguccccggcugggacuccgcccccggcgcccccucccccgccgacaucacccaccccacccccgcccccggccccuccgcccacgccgcccccuccaccaccuccgcccucacccccggccccgccgccgccgccgccgacgccgccgccuccuccgucgccaagggcggcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6503 - RNA, 1536 nt, Artificial Sequence
  mRNA product Design5 comprising derived and/or modified sequence from Homo sapiens__NP_005420.1__HsVEGFC (opt2)
gggagagucccgcagucggcguccagcggcucugcuuguucgugugugugucguugcaggccuuauucaagcuuaccaugcaccuccucggcuucuucuccgucgccugcucccuccucgccgccgcccuccuccccggcccccgcgaggcccccgccgccgccgccgccuucgaguccggccucgaccucuccgacgccgagcccgacgccggcgaggccaccgccuacgccuccaaggaccucgaggagcagcuccgcuccgucuccuccgucgacgagcucaugaccguccucuaccccgaguacuggaagauguacaagugccagcuccgcaagggcggcuggcagcacaaccgcgagcaggccaaccucaacucccgcaccgaggagaccaucaaguucgccgccgcccacuacaacaccgagauccucaaguccaucgacaacgaguggcgcaagacccagugcaugccccgcgaggucugcaucgacgucggcaaggaguucggcgucgccaccaacaccuucuucaagccccccugcgucuccgucuaccgcugcggcggcugcugcaacuccgagggccuccagugcaugaacaccuccaccuccuaccucuccaagacccucuucgagaucaccgucccccucucccagggccccaagcccgucaccaucuccuucgccaaccacaccuccugccgcugcauguccaagcucgacgucuaccgccagguccacuccaucauccgccgcucccuccccgccacccucccccagugccaggccgccaacaagaccugccccaccaacuacauguggaacaaccacaucugccgcugccucgcccaggaggacuucauguucuccuccgacgccggcgacgacuccaccgacggcuuccacgacaucugcggccccaacaaggagcucgacgaggagaccugccagugcgucugccgcgccggccuccgccccgccuccugcggcccccacaaggagcucgaccgcaacuccugccagugcgucugcaagaacaagcucuuccccucccagugcggcgccaaccgcgaguucgacgagaacaccugccagugcgucugcaagcgcaccugcccccgcaaccagccccucaaccccggcaagugcgccugcgagugcaccgaguccccccagaagugccuccucaagggcaagaaguuccaccaccagaccugcuccugcuaccgccgccccugcaccaaccgccagaaggccugcgagcccggcuucuccuacuccgaggaggucugccgcugcguccccuccuacuggaagcgcccccagauguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6504 - RNA, 1341 nt, Artificial Sequence
  mRNA product Design5 comprising derived and/or modified sequence from Homo sapiens__NP_004460.1__HsVEGFD (opt2)
gggagagucccgcagucggcguccagcggcucugcuuguucgugugugugucguugcaggccuuauucaagcuuaccauguaccgcgagugggucgucgucaacgucuucaugaugcucuacguccagcucguccagggcuccuccaacgagcacggccccgucaagcgcuccucccaguccacccucgagcgcuccgagcagcagauccgcgccgccuccucccucgaggagcuccuccgcaucacccacuccgaggacuggaagcucuggcgcugccgccuccgccucaaguccuucaccuccauggacucccgcuccgccucccaccgcuccacccgcuucgccgccaccuucuacgacaucgagacccucaaggucaucgacgaggaguggcagcgcacccagugcuccccccgcgagaccugcgucgaggucgccuccgagcucggcaaguccaccaacaccuucuucaagccccccugcgucaacgucuuccgcugcggcggcugcugcaacgaggagucccucaucugcaugaacaccuccaccuccuacaucuccaagcagcucuucgagaucuccgucccccucaccuccguccccgagcucguccccgucaaggucgccaaccacaccggcugcaagugccuccccaccgccccccgccaccccuacuccaucauccgccgcuccauccagauccccgaggaggaccgcugcucccacuccaagaagcucugccccaucgacaugcucugggacuccaacaagugcaagugcguccuccaggaggagaacccccucgccggcaccgaggaccacucccaccuccaggagcccgcccucugcggcccccacaugauguucgacgaggaccgcugcgagugcgucugcaagacccccugccccaaggaccucauccagcaccccaagaacugcuccugcuucgagugcaaggagucccucgagaccugcugccagaagcacaagcucuuccaccccgacaccugcuccugcgaggaccgcugccccuuccacacccgccccugcgccuccggcaagaccgccugcgccaagcacugccgcuuccccaaggagaagcgcgccgcccagggcccccacucccgcaagaaccccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6505 - RNA, 906 nt, Artificial Sequence
  mRNA product Design5 comprising derived and/or modified sequence from Homo sapiens__NP_061986.1__HsFGF21 (opt3)
gggagagucccgcagucggcguccagcggcucugcuuguucgugugugugucguugcaggccuuauucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugaguuacugcuugaagauggguauaacgucuaccagagcgaggcacacggauugccccugcaucuaccugguaauaaaaguccacacagagaccccgccccuaggggcccagcucgguuucucccgcugcccgggcuuccuccagcccugcccgaaccuccaggaauuuuggcgccccagccgccugaugugggcuccucugacccccucagcaugguugguccaucccaggggcgcucaccuaguuaugcaagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6506 - RNA, 1686 nt, Artificial Sequence
  mRNA product Design5 comprising derived and/or modified sequence from Homo sapiens__NP_002412.1__HsMMP1 (opt3)
gggagagucccgcagucggcguccagcggcucugcuuguucgugugugugucguugcaggccuuauucaagcuuaccaugcacagcuuucccccucugcuccuucuguuguucuggggcguggucucccauucuuucccagccaccuuagagacacaggaacaagacguugaucuggugcagaaguaccuagagaaauauuacaaccucaagaaugacgggagacagguagagaaaaggcggaacucaggaccgguggucgaaaagcugaaacagaugcaagaauuuuucggucuuaaggugacuggcaagcccgaugcugagacgcugaaaguuaugaagcagccucgcugcggggugccagacgucgcacaguuuguguugaccgagggaaauccccgaugggaacagacacaccucacuuaucguaucgagaacuacaccccugaucugccaagagccgacguagaucaugcgauugaaaaggcuuuccaacuguggaguaauguuacaccccucaccuuuacuaaagugagcgagggccaggccgacauaaugaucuccuucgucaggggugaucaccgggacaacucuccuuuugaugggccaggaggcaauuuagcacaugccuuccagccgggccccgggauuggaggugacgcucacuuugaugaggacgaacgcuggacaaacaauuucagagaguauaaccugcacaggguggcagcccaugaacuuggccacucguuggggcugucacauagcaccgacaucggagcucuaauguacccuaguuauacguuuuccggcgaugugcagcucgcccaagacgauauugacgguauccaggcgauauacgggcggucucagaauccaguccaacccaucggaccucagacuccaaaagcaugugauagcaagcugaccuucgacgccauuacaacuauccgcggcgagguuauguucuuuaaggaucgauucuacaugagaaccaaccccuuuuauccggaaguggagcuuaauuucauuuccguauuuuggccucagcugcccaacggcuuggaggcugccuacgaguucgcagacagggaugaagugcgguuuuucaaagggaauaaguauugggcuguccagggacaaaacgugcuccacgguuacccaaaagacaucuauucaaguuuuggcuucccucguacaguuaagcacauagaugccgcgcugagcgaagagaacaccgggaaaacguacuuuuucguggccaauaaguauuggcgcuacgacgaauacaaaagaucuauggaccccggauauccaaagaugauugcacaugauuuucccggcaucggucacaaggucgacgcuguguucaugaaagauggguucuuuuacuucuuucauggcacuaggcaguauaaguucgacccuaaaacaaagcggauuuuaacccugcagaaagccaacuccugguuuaauugccgaaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6507 - RNA, 1446 nt, Artificial Sequence
  mRNA product Design5 comprising derived and/or modified sequence from Homo sapiens__NP_002412.1__HsMMP1(1-19,100-469) (opt3)
gggagagucccgcagucggcguccagcggcucugcuuguucgugugugugucguugcaggccuuauucaagcuuaccaugcacagcuuucccccucugcuccuucuguuguucuggggcguggucucccauucuuucguuuuaaccgaggggaacccaagaugggaacagacacaccugacuuacaggaucgagaauuauacgccggaccuaccccgggccgauguggaccaugcuauugaaaaggcauuucaacucuggucaaacguaaccccucugacauucacuaaagugagugagggacaggccgauauaaugaucagcuuuguccgcggugaccaccgagauaauuccccauucgacggccccgggggaaaccuugcgcaugcuuuucagccuggcccagguauugggggagaugcccacuucgacgaagaugagcguuggaccaauaacuuuagagaguacaaucugcacaggguggcagcccaugaauugggccacucucucggccugucgcauucaacagacaucggggcucugauguaucccagcuacaccuucaguggagauguucagcucgcacaagacgauauugacgguauccaggccauauauggccggucccagaacccugugcagccaaucgggccgcaaacucccaaggcuugcgacucuaaauuaacauuugaugccauuaccacgauccgcggagaggucauguucuuuaaggacagauucuacaugaggacuaauccuuucuauccagaaguggagcugaacuuuauuagcguauucuggccccagcuuccuaauggcuuggaggcggcauacgaauuugccgaucgggacgagguucgcuucuuuaaagguaacaaguacugggcugugcaggggcagaauguccugcacggauauccaaaggauaucuacuccucauucggcuuuccccgaaccgugaaacacauagacgccgcacuaagugaagagaacacaggcaagacuuauuucuuuguggcuaauaaauacuggagauaugaugaauacaagaggagcauggacccgggguauccuaaaaugauugcccaugauuuccccggaaucggucacaaggucgacgcgguuuuuaugaaggauggcuucuuuuacuucuuccaugggacccggcaauacaaauuugacccaaagacaaaacguauucucacccugcagaaggccaacucuugguucaacugucgcaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6508 - RNA, 3633 nt, Artificial Sequence
  mRNA product Design5 comprising derived and/or modified sequence from Clostridium histolyticum__BAA77453.1__ColG (opt3)
gggagagucccgcagucggcguccagcggcucugcuuguucgugugugugucguugcaggccuuauucaagcuuaccaugaagaaaaacauccugaagauucucauggacagcuacuccaaagagucuaagauacagaccgugagaagggucacaucaguuagucuucuggccguguauuugacuaugaauacgagcuccuuaguacuggcuaaacccaucgaaaacaccaaugauacaucuauuaagaacguggagaagcuacggaaugcaccuaacgaagaaaauucgaaaaaggucgaagacucaaagaacgauaagguggagcacguuaaaaauaucgaggaagccaagguggagcaagucgcgccagaaguaaagagcaaaaguacucuccgcuccgcuucuauugccaacaccaauagcgagaaguacgacuucgaguaucugaacggccuuuccuacacagaacugaccaauuugaucaaaaacauaaaguggaaucagaucaacgggcucuuuaacuauucaacuggaagucagaaauucuuuggugauaagaaucgagugcaggcaauuaucaacgcccugcaagagagcggccguacauacaccgcuaaugacaugaaagggauugaaacguucacugagguucugagagcaggauuuuaucucggcuacuacaacgaugguuuaucuuaucugaaugacaggaacuuccaggauaagugcaucccggccaugauagcuauucagaagaaucccaacuuuaaacuugggaccgccgugcaggacgaagucaucacauccuugggaaagcugauuggcaaugcgucagcaaacgccgagguggugaauaacugugucccuguucuaaaacaauuccgggagaaucucaaccaguacgcuccagauuaugugaagggcacugccguaaaugaacugaucaaagggaucgaguuugacuucagcggagcagcuuacgaaaaggaugugaagaccaugcccugguaugguaaaauugacccuuuuauaaacgagcuuaaggcccugggcuuguacgggaacaucacaagugcgaccgaaugggccucugacgucggaauuuauuaccucuccaaauucggccuguacagcacgaaucgcaacgauaucgugcagucguuagagaaggcaguugacauguauaaauacgguaagauagcuuuuguggccauggagagaauuacuugggauuaugacgggaucggaucuaauggcaagaaagucgaucaugacaaguuccuggaugacgcugaaaaacacuaccucccaaagacauauaccuucgauaacggcacuuuuaucauuagggccggggacaaaguguccgaggaaaagaucaagcggcuuuacugggcaucacgcgagguaaaaagucaguuccaucgaguugugggaaaugauaaggcccuggaagucgguaacgcugacgacguguugacaaugaaaauuuuuaauagccccgaggaguauaaguucaacaccaauauaaacggcgucuccacggauaaugggggacuauacaucgaaccuagaggcaccuuuuacacauaugagaggacuccacaacagucuauuuucagccuggaggagcucuuucggcacgaguacacccauuaucugcaggcgcguuaccuuguggacggucugugggggcaaggcccguucuaugaaaagaaccgcuugacaugguuugaugagggaacugcagaguucuuugccggcucaaccagaacaagugggguucuccccaggaaguccauccugggauacuuagcuaaagacaagguggaucaccgguauagccugaagaaaacccuaaauucugguuacgacgauucagacuggauguucuacaacuauggcuuugccguagcacacuaccucuaugaaaaggauaugccuacuuucaucaaaaugaauaaggccauucugaacacggacgucaaaaguuacgaugaaauaaucaagaaacuuagcgacgaugcuaacaaaaauacagaguaucagaaccauauucaggaguuggccgacaaguaccagggggcaggaaucccacugguguccgacgauuaucucaaagaccacggcuacaagaaagcgucugaaguuuacucggagauuagcaaggcugccucccugaccaauacuucagugaccgcagaaaagagucaauauuucaacacauuuacccuucgagguacuuacacaggggagacgucuaaaggcgaguucaaggauugggacgaaaugagcaaaaagcuggauggaaccuuggagucccucgccaaaaauucauggagcggcuauaagacucugacagcuuacuuuaccaacuaucgcgucacaucugacaauaaggugcaguacgauguaguguuccaugggguuuuaacugacaacgccgauaucuccaauaacaaagcacccauagcuaaggucaccggaccuaguacgggugccgugggcagaaauaucgaauuuagcgggaaagacucuaaggaugaggacggaaaaauuguguccuaugauugggacuucggcgacggugcgaccucaagggggaagaacaguguccacgccuacaaaaaggcuggcacauacaauguuacucugaaggugaccgaugacaaaggagcaacagccacugagagcuuuaccaucgaaauuaagaacgaagauacgacaaccccaaucacuaaagagauggagcccaaugacgauauaaaggaagcuaacggcccgauuguggaggggguaacagucaaaggagaccuaaacggcucggaugacgccgauaccuucuauuuugacgugaaggaagauggugacguuacuaucgagcucccuuacuccgggucuagcaauuucaccuggcugguguauaaggagggagacgaucagaaccacauugcaucaggcaucgacaaaaauaacaguaaggucgguacauuuaaauccacgaagggccggcauuacguguucauauauaaacacgauucugcgagcaauaucuccuacucacuuaacauuaagggguugggaaaugaaaagcugaaagagaaggaaaacaaugacagcagugauaaagccaccguuauccccaacuuuaauacuacaaugcagggcucucuccugggggacgauucccgcgacuauuacagcuucgaggugaaggaagagggagagguaaacauugaauuagauaaaaaggacgaguucggcgucaccuggacacugcauccagaaucgaauaucaacgauagaauaacuuacggucaaguggacgggaauaaggugucaaacaaagucaaacuuaggccuggaaaauauuacuugcucguuuauaaguacucuggcagugguaauuaugagcugcgugugaacaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6509 - RNA, 3357 nt, Artificial Sequence
  mRNA product Design5 comprising derived and/or modified sequence from Clostridium histolyticum__BAA77453.1__HsALB(1-18)_ColG(111-1118) (opt3)
gggagagucccgcagucggcguccagcggcucugcuuguucgugugugugucguugcaggccuuauucaagcuuaccaugaagugggugaccuucaucagccugcucuuucuuuucuccucugccuacucaauugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6510 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt3)
gggagagucccgcagucggcguccagcggcucugcuuguucgugugugugucguugcaggccuuauucaagcuuaccaugaagugggugaccuucaucagccugcucuuucuuuucuccucugccuacucaaugaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6511 - RNA, 3381 nt, Artificial Sequence
  mRNA product Design5 comprising derived and/or modified sequence from Clostridium histolyticum__BAA34542.1__ColH (opt3)
gggagagucccgcagucggcguccagcggcucugcuuguucgugugugugucguugcaggccuuauucaagcuuaccaugaacuuccugaagaucauucucaauagaggcaaaaccaugaagaggaaaugccuuagcaagcggcugauguuggccauaacaauggcuacuaucuuuacggugaacuccaccuuacccauuuacgcagccgucgacaaaaauaacgcgacagcugccguucagaaugagucuaagcgcuauacugugucauaccugaagacccuaaacuauuacgaucucguagaccugcuugugaaaacagaaaucgagaaucugccugauuuguuccaauauaguagcgacgcaaaggaauuuuacgggaacaaaacccgaauguccuucauuauggaugagaucggacguagagccccacaguauacugaaauagaccacaaggguaucccgacacucgucgaggugguuagggcuggcuuuuaccugggguuccauaauaaagagcugaacgaaauuaauaagcggucuuuuaaggagcgcgugauccccucgauucucgcaauccagaaaaacccuaauuucaaguuaggaaccgaaguccaggauaaaauagugucagccacgggccugcuugcugguaacgagacugccccacccgagguaguuaauaacuuuaccccuauuuugcaagacuguaucaagaacauugauagauacgcgcuggacgaucuaaaaagcaaggcacucuucaaugugcuggccgcuccaacauaugacaucacugaauaccuuagggccaccaaagagaagcccgaaaacacaccuugguaugggaagaucgauggauuuauuaaugagcugaaaaaguuggcacucuacggcaaaauaaacgacaauaacaguuggaucauugacaauggcaucuaucacauagcuccacuggggaaguuacauuccaacaauaaaauuggaaucgaaacccugacggaggucaugaagguguacccguaucucucuaugcagcaccuucagagcgccgaucagaucaagcggcauuacgacuccaaagaugcggaggguaacaagauuccccuggacaaauucaagaaagaaggcaaggagaaguacugcccuaaaacuuauacauuugaugacgggaaggugaucauuaaagccggagcacgcgucgaagaggaaaagguuaaacgauuguacugggcuucaaaggaggugaauagucaauucuucagaguauauggcauagauaagccacuagaggaagguaaccccgacgauauccugaccauggugauuuacaauagcccugaggaauauaaacucaacucuguccuguacggguaugacacuaauaacggaggcauguacaucgagccagaaggcacauuuuucaccuacgagagggaggcccaggaauccacguauacccuugaggaacuguuucggcacgaguacacacacuauuugcaggggcguuacgcugugcccggacaguggggucgcacuaagcucuaugauaacgacagacugaccugguacgaggaaggcggggccgaguuauucgcaggaucaacaaggacuagcggcauccugccgcggaaaaguauuguuucuaauauacauaacaccacacgaaauaaccgcuauaagcuauccgacaccgugcacagcaaauacggugccucguuugaguucuacaauuaugcuuguauguuuauggauuacauguauaacaaggacauggggauccucaauaaacugaacgaucuugcgaagaauaacgacgucgauggcuacgacaauuauauuagagauuugucuuccaacuacgcacugaaugacaaguaucaagaucauaugcaggaaaggaucgacaacuacgaaaaucucacugugccuuucguagccgaugacuaccugguucggcacgcuuauaaaaaccccaacgagauuuacucagagaucagugaaguggccaaacuuaaggaugcaaagagcgaggucaaaaagucccaguauuuuucuacguucacacugcgcggaagcuacaccggcggggccucaaagggaaaauuggaagaccaaaaggcuaugaauaaauuuauagacgauagucucaagaaacuggacacuuauuccuggagcgguuacaagaccuuaacagccuauuucaccaacuacaagguggauucuucaaauagagucacuuacgacgugguuuuucacggcuaucugccaaacgagggggauaguaaaaauagccuaccuuacggaaagaucaacggcacauauaaagguacggaaaaggagaaaauuaaguucuccucugaggggucguucgaccccgauggcaagaucgugagcuacgaaugggacuuuggagauggcaauaaauccaacgaggaaaauccagagcauucauaugacaagguagggaccuacacugucaaacucaaggugacagaugacaaaggagaaaguucuguuagcaccacaacugcagagauuaaggaucuguccgagaacaaacuucccgugaucuauaugcacgucccuaagucaggugcguugaaucagaaggugguauucuacggcaaagggaccuacgacccagacggaagcauagcuggcuaucagugggauuuuggugacgggucugauuucuccagugaacagaacccgagccauguguacacgaagaaaggcgaguauaccguuacacugagggucauggacucuuccggacaaaugucagaaaagacuaugaaaauuaagaucaccgaucccguguacccuauuggcacagagaaggagccaaauaacaguaaagaaacugccagcgggcccaucgugccuggaauaccagucucgggcaccaucgagaauacguccgaccaggauuauuuuuacuucgacguuauuacacccggugaagugaagaucgauauuaacaaacucggguauggaggcgcaaccugggugguauacgacgagaacaauaacgccgucucuuacgcuacugaugacggucagaaucugagcggcaaguuuaaagccgacaagccggggcguuauuacauccacuuauauauguucaacggaucauacaugccuuaucggauaaauauugaaggcaguguggggcgaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6512 - RNA, 3342 nt, Artificial Sequence
  mRNA product Design5 comprising derived and/or modified sequence from Clostridium histolyticum__BAA34542.1__ColH (opt3)
gggagagucccgcagucggcguccagcggcucugcuuguucgugugugugucguugcaggccuuauucaagcuuaccaugaagagaaaaugccugagcaagaggcucaugcuugccaucaccauggcuacaauuuucacugugaacuccacgcugcccauauacgcagccgucgacaaaaauaacgcgaccgcugccguucagaaugagucuaagcgguauacagugucauacuugaaaacuuuaaacuauuacgaucugguagaccuacucgugaagaccgaaaucgagaaucugccugaucuuuuucaauauaguagcgacgcaaaggaguucuacggcaacaaaacacgcauguccuuuauuauggaugaaaucgggcgacgugccccacaguauaccgaaauugaccacaagggaaucccgacucuggucgaggugguuagagcugguuucuacuugggcuuucauaauaaagagcucaacgaaauaaauaagaggucuuucaaagagcgggugauccccucgauucuggcaauccagaagaacccuaauuuuaagcuggggacagaaguccaggauaaaauugugucagccaccggacucuuagcuggcaacgagacggccccacccgagguaguuaauaacuucacuccuauccugcaagacuguauaaagaauauugaucgcuacgcgcuugacgauuugaaaagcaaggcacuguuuaacgugcuagccgcuccaaccuaugacaucacagaauaccucagagccacuaaagagaagcccgaaaacaccccuugguaugguaaaauugauggguucaucaaugagcugaagaagcuggcacuguacggaaaaaucaacgacaauaacaguuggauuauagacaauggcaucuaucacauugcuccauugggcaagcuccauuccaacaauaaaaucgggauagaaacacugaccgaggucaugaagguguacccguauuuaucuaugcagcaccuucagagcgccgaucagauuaaaaggcauuacgacuccaaggaugcggagggaaacaagaucccccucgacaaauuuaagaaagaagguaaggagaaauacugcccuaagacguauacuuucgaugacggcaaggugaucauuaaagccggggcacgggucgaagaggaaaagguuaaacgccuuuacugggcuucaaaggaggugaauagucaauuuuuccgaguauauggaaucgauaaaccacuggaggaaggcaaccccgacgauauuuugacaauggugauauacaauagcccugaggaauauaagcuaaacucuguccuguacgguuaugacaccaauaacgggggaauguacaucgagccagaaggcacuuucuuuacauacgagagagaggcccaggaauccaccuauacgcucgaggaacuguucaggcacgaguacacccacuaucuucagggccgguacgcugugcccgggcaguggggacguacaaagcuguaugauaaugaccgcuugacuugguacgaggaagguggcgccgagcucuuugcagggucaaccagaacaagcggcauucugccgaggaaaaguaucguuucuaacauccauaacacuacccggaauaaccgauauaaguuauccgacacagugcacagcaaauacggagccucguucgaauuuuacaauuaugcuuguauguucauggauuacauguauaacaaggacauggguauucugaauaaacuaaacgaucucgcgaagaauaacgacgucgauggguacgacaauuauauacgcgaucugucuuccaacuacgcacuuaaugacaaauaucaagaucauaugcaggagagaaucgacaacuacgaaaauuugaccgugccuuuuguagccgaugacuaccugguuaggcacgcuuauaagaaccccaaugagauuuacucagagaucagugaaguggccaagcucaaagaugcaaagagcgaggucaaaaagucccaguauuucucuacuuuuacgcugcggggcagcuacacaggaggcgccucaaaagggaaacuugaagaccaaaaggcuaugaacaaguucauugacgauagucugaagaaauuggacaccuauuccuggagcggauacaagacucucaccgccuauuuuacaaacuacaaaguggauucuucaaaucgcgucaccuacgacgugguuuuccacgguuaucugccaaacgagggcgauaguaagaauagcuuaccuuacgggaagaucaacggaacuuauaaaggcacagaaaaggagaaaauaaaguuuuccucugaggguucguucgaccccgaugggaaaaucgugagcuacgaaugggacuucggcgauggaaauaaguccaacgaggaaaauccagagcauucauaugacaagguaggcacguacaccgucaaacugaaggugacugaugacaaaggggaaaguucuguuagcacaaccacagcagagauuaaggaucuauccgagaacaaacuccccgugaucuauaugcacgucccuaagucaggagcgcugaaucagaaagugguauuuuacgguaagggcacuuacgacccagacgggagcauugcuggauaucagugggauuucggcgacgguucugauuuuuccagugaacagaacccgagccauguguacaccaagaaaggggaguauacgguuacccuuagagucauggacucuuccggccaaaugucagaaaagacaaugaaaaucaagauaacugaucccguguacccuauuggaaccgagaaagagccaaauaacaguaaggaaacagccagcggccccaucgugccugggauuccagucucgggaacuaucgagaauaccuccgaccaggauuauuucuacuuugacguuauaacgcccggcgaagugaagaucgauauuaacaaauuggguuaugggggagcaacaugggugguauacgacgagaauaacaacgccgucucuuacgcuaccgaugacggccagaaucugagcgguaaguucaaagccgacaagccgggcagguauuacauccaccucuauauguuuaacgggucauacaugccuuaucguauuaauaucgaaggaagugugggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6513 - RNA, 3276 nt, Artificial Sequence
  mRNA product Design5 comprising derived and/or modified sequence from Clostridium histolyticum__BAA34542.1__HsALB(1-18)_ColH(41-1021) (opt3)
gggagagucccgcagucggcguccagcggcucugcuuguucgugugugugucguugcaggccuuauucaagcuuaccaugaagugggugaccuucaucagccugcucuuucuuuucuccucugccuacucaguccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggaggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6514 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt3)
gggagagucccgcagucggcguccagcggcucugcuuguucgugugugugucguugcaggccuuauucaagcuuaccaugaagugggugaccuucaucagccugcucuuucuuuucuccucugccuacucaaugaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6515 - RNA, 852 nt, Artificial Sequence
  mRNA product Design5 comprising derived and/or modified sequence from Homo sapiens__NP_001133.1__HsAMELX (opt3)
gggagagucccgcagucggcguccagcggcucugcuuguucgugugugugucguugcaggccuuauucaagcuuaccaugggcaccuggauccuguucgccugccuccuuggggcugcauuugccaugccccugccuccacacccgggacaucccgguuacauuaacuucagcuaugagguguugacaccuuuaaagugguaccaguccauaagaccacccuauccuucuuacggcuaugaaccaaugggaggguggcugcaccaucaaaucauucccguccuaucacagcagcacccuccaacucauacgcuccagccgcaccaccauauccccguugugccugcgcaacagccaguaauuccccagcagccuaugaugccagugcccggccaacacaguaugaccccgauccagcaucaccagccuaaucugcccccuccagcucagcaacccuaccagccacagcccguccaaccucagccacaccagccgaugcagccccaaccuccagugcaucccaugcagccucuuccaccccagccgccucugccacccauguuuccuaugcagcccuugccaccuaugcuccccgaccugacacuggaggccuggccaagcacugauaaaaccaagagggaagagguugacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6516 - RNA, 411 nt, Artificial Sequence
  mRNA product Design5 comprising derived and/or modified sequence from Homo sapiens__NP_001133.1__HsAMELX-TRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccaguccauuagaccacccuauccuucuuacggauaugaaccaauggguggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6517 - RNA, 444 nt, Artificial Sequence
  mRNA product Design5 comprising derived and/or modified sequence from Homo sapiens__NP_001133.1__HsAMELX-LRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccaguccauuagaccacccccuaugcugccagacuugacauuagaagccuggcccucuacugauaaaacgaagagggaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6518 - RNA, 483 nt, Artificial Sequence
  mRNA product Design5 comprising derived and/or modified sequence from Homo sapiens__NP_001133.1__HLA-A2-SP_HsAMELX(17-60) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuauuaggcccccuuauccaucauacgguuaugaacccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6519 - RNA, 516 nt, Artificial Sequence
  mRNA product Design5 comprising derived and/or modified sequence from Homo sapiens__NP_001133.1__HLA-A2-SP_HsAMELX(17-47,168-191) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuauuaggcccccuccaaugcugcccgaccuuacccuggaggcuuggccuucaacagauaaaacuaagcgggaagaaguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6520 - RNA, 855 nt, Artificial Sequence
  mRNA product Design5 comprising derived and/or modified sequence from Homo sapiens__NP_001134.1__HsAMELY (opt3)
gggagagucccgcagucggcguccagcggcucugcuuguucgugugugugucguugcaggccuuauucaagcuuaccaugggcaccuggauccuguucgccugccucgugggggcugcauuugccaugccccuuccuccacacccgggacaucccgguuacauuaacuucagcuaugagguccugacaccuuugaagugguaccaguccaugauaagaccacccuauucuucauacggcuaugaaccuaugggagggugguuacaccaucaaaucauuccaguugugagucagcagcacccccugacucauacgcuacagagccaccaccauaucccuguagugccagcgcaacagccgaggguccggcagcaggcucucaugcccgugccuggccaacaguccaugaccccaacacagcaccaucagcccaaucugccucuuccagcccaacagcccuuucagccgcaaccuguucagccccagccacaccagccuaugcaaccccagccacccgugcagccuaugcagccacuguugccgcaacccccucucccacccauguucccucugcgcccacugcccccgauucucccugacuuacaccuggaggcauggccagccacugauaaaaccaagcaggaagaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6521 - RNA, 414 nt, Artificial Sequence
  mRNA product Design5 comprising derived and/or modified sequence from Homo sapiens__NP_001134.1__HsAMELY-TRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccaguccaugauuagaccacccuauucuucauacggauaugaaccuauggguggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6522 - RNA, 447 nt, Artificial Sequence
  mRNA product Design5 comprising derived and/or modified sequence from Homo sapiens__NP_001134.1__HsAMELY-LRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccaguccaugauuagaccacccccuauacugccagacuugcacuuagaagccuggcccgcuacagauaaaacuaagcaagaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6523 - RNA, 486 nt, Artificial Sequence
  mRNA product Design5 comprising derived and/or modified sequence from Homo sapiens__NP_001134.1__HLA-A2-SP_HsAMELY(17-61) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuaugauuaggcccccuuauucaaguuacgguuaugaaccaaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6524 - RNA, 519 nt, Artificial Sequence
  mRNA product Design5 comprising derived and/or modified sequence from Homo sapiens__NP_001134.1__HLA-A2-SP_HsAMELY(17-48,169-192) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuaugauuaggcccccuccaauacugcccgaccuucaccuggaggcuuggccugccaccgauaaaacaaagcaggaagaaguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6525 - RNA, 846 nt, Artificial Sequence
  mRNA product Design5 comprising derived and/or modified sequence from Sus scrofa__NP_999071.1__SsAMELX-001-1 (opt3)
gggagagucccgcagucggcguccagcggcucugcuuguucgugugugugucguugcaggccuuauucaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccauauacuucuuacggcuaugaacccaugggaggguggcugcaucaccaaaucauuccugucguuucacagcagacgccacagagucaugcccuacaaccccaccaccauaucccuauggugccagcgcagcagccgggcauuccccagcaaccuaugaugccacuccccggucagcacagcaugaccccuacacagcaucaccagccaaaccugccccuuccggcucaacagccuuuucagccccaaccaguacagccucagccccaccagccacugcaaccccaguccccuaugcauccaauccagccguugcucccccagccuccacugcccccuauguucucuaugcaaucgcugcucccagacuuaccccuggaggccuggccggcaacugauaaaaccaagagggaagagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6526 - RNA, 414 nt, Artificial Sequence
  mRNA product Design5 comprising derived and/or modified sequence from Sus scrofa__NP_999071.1__SsAMELX-TRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccagaauaugauuagacacccauauacauccuacggauaugaacccauggguggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6527 - RNA, 447 nt, Artificial Sequence
  mRNA product Design5 comprising derived and/or modified sequence from Sus scrofa__NP_999071.1__SsAMELX-LRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccagaauaugauuagacacccaucccuguugcccgacuuaccucuggaagccuggccagcuacagauaaaacuaagagggaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6528 - RNA, 486 nt, Artificial Sequence
  mRNA product Design5 comprising derived and/or modified sequence from Sus scrofa__NP_999071.1__HLA-A2-SP_SsAMEL(17-61) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaaauaugauuaggcaccccuauaccucuuacgguuaugaaccuaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6529 - RNA, 519 nt, Artificial Sequence
  mRNA product Design5 comprising derived and/or modified sequence from Sus scrofa__NP_999071.1__HLA-A2-SP_SsAMEL(17-49,167-189) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaaauaugauuaggcaccccucucugcuuccugaccugccauuggaggcuuggcccgccaccgauaaaacaaagcgggaagaaguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6530 - RNA, 810 nt, Artificial Sequence
  mRNA product Design5 comprising derived and/or modified sequence from Sus scrofa__P45561-2__SsAMELX-001-2 (opt3)
gggagagucccgcagucggcguccagcggcucugcuuguucgugugugugucguugcaggccuuauucaagcuuaccaugggcaccuggauccuguucgccugccuccuuggggcugcauuuagcaugccccugccuccacacccgggacaucccgguuacauuaacuucuccuauauaagacacccuuacacaucuuauggcuacgagccaaugggagggugguugcaucaccagaucauucccguggucucacaacagacuccucagagucaugccuuacagccacaccaccauauccccaugguuccugcgcaacagccaggcauuccgcagcagcccaugaugccucugccaggucaacacagcaugacgcccacccagcaucaccagccuaaucuaccacuccccgcucagcaaccguuucagccucagcccgugcaaccacagccucaccagccccugcagccacaaucccccaugcauccuauccagccacuucugccgcagcccccuuugccacccauguucucuaugcagucgcuccugccugaccugccacucgaagccuggcccgcaacagauaagacuaaaagggaggaaguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6531 - RNA, 846 nt, Artificial Sequence
  mRNA product Design5 comprising derived and/or modified sequence from Sus scrofa__NP_998965.1__SsAMELX-001-3 (opt3)
gggagagucccgcagucggcguccagcggcucugcuuguucgugugugugucguugcaggccuuauucaagcuuaccaugggcaccuggaucuucuuugccugccugcucggggcuagccuugcaaugccccugccuccacacccgggacaucccgguuacauuaacuucuccuaugagguguugacaccuuuaaagugguaccagaauaugauaagacacccauauacuucuuacggcuaugaacccaugggaggguggcugcaucaccaaaucauuccugucguuucacagcagacgccacagagucaugcccuacaaccccaccaccauaucccuauggugccagcgcagcagccgggcauuccccagcaaccuaugaugccacuccccggucagcacagcaugaccccuacacagcaucaccagccaaaccugccccuuccggcucaacagccuuuucagccccaaccaguacagccucagccccaccagccacugcaaccccaguccccuaugcauccaauccagccguugcucccccagccuccacugcccccuauguucucuaugcaaucgcugcucccagacuuaccccuggaggccuggccggcaacugauaaaaccaagagggaagagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6532 - RNA, 495 nt, Artificial Sequence
  mRNA product Design5 comprising derived and/or modified sequence from Sus scrofa__K7GPB2__SsAMELX-002 (opt3)
gggagagucccgcagucggcguccagcggcucugcuuguucgugugugugucguugcaggccuuauucaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccaucucugcuacccgaccucccucuggaagccuggccagcgacugauaaaacgaagagggaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6533 - RNA, 888 nt, Artificial Sequence
  mRNA product Design5 comprising derived and/or modified sequence from Sus scrofa__K7GLD0__SsAMELX-003 (opt3)
gggagagucccgcagucggcguccagcggcucugcuuguucgugugugugucguugcaggccuuauucaagcuuaccaugggcaccuggauccuguucgccugccuccuuggggcugcauuuagcaugccccugccuccacacccgggacaucccgguuacauuaacuucuccuaugaggacuuguacuuagaagccauaagaaucgauaggacagcguuugugcugacuccucuaaagugguaucagaauaugauucggcacccauacacgucuuauggcuacgagcccaugggaggguggcuccaucaccaaaucauuccugucguuucacagcagaccccacagagucaugcucugcaaccccaccaccauaucccuauggugccagcccagcagccgggcauaccccagcaaccuaugaugccacuucccggucagcacagcaugacaccuacucagcaucaccagccaaaccugcccuugccggcacaacagccuuuccagccccaaccaguacagccucagccccaccagccacuccaaccccaguccccuaugcauccaauccagccgcugcugccccagccuccauuacccccuauguuuucuaugcaaucgcuccugccagaccuucccuuggaagccuggccggcuaccgauaaaacaaagcgcgaggaaguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6534 - RNA, 774 nt, Artificial Sequence
  mRNA product Design5 comprising derived and/or modified sequence from Sus scrofa__K7GPE9__SsAMELX-004 (opt3)
gggagagucccgcagucggcguccagcggcucugcuuguucgugugugugucguugcaggccuuauucaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccaacuccccaaucucaugcccugcagccucaccaucacaucccaaugguccccgcgcagcagccuggcauuccacaacagccgaugaugccccuaccugggcagcacucaaugacgccaacccagcaucaccaacccaaccucccucugccagcucagcagcccuuucagccgcaaccuguucagccccagccacaucaaccucuucagccccagaguccaaugcaccccauccagccucuguugccacaaccgccccucccuccaauguucagcaugcagucccugcugcccgaccucccuuuagaagccuggccagcaacagauaaaacuaagagggaggaaguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6535 - RNA, 798 nt, Artificial Sequence
  mRNA product Design5 comprising derived and/or modified sequence from Sus scrofa__J9JIM4__SsAMELX-201 (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccagaauaugauuagacacccauauacauccuacggauaugaacccauggguggcuggcugcaucaccaaauaaucccugucguuucucagcagacuccacagucacaugccuugcaaccccaccaccauauuccuauggugccagcucagcagccggggaucccccagcaaccuaugaugccauuacccggacagcacaguaugacgccuacccagcaucaccagccaaaccugccccuaccggcacaacagccuuuucagccccaaccaguacagccucagccccaccagccacuccaaccccagagcccuaugcauccaauucagccgcugcuuccccagccuccacugcccccuauguucuccaugcaaucuuugcucccagaccugccccuggaggccuggccggcgacagauaaaacuaagagggaagagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6536 - RNA, 3237 nt, Artificial Sequence
  mRNA product Design5 comprising derived and/or modified sequence from Homo sapiens__NP_006120.1__HsBMP1 (opt3)
gggagagucccgcagucggcguccagcggcucugcuuguucgugugugugucguugcaggccuuauucaagcuuaccaugcccggcguggccagacugccucuccuucugggguuguuacugcuaccaaggccgggacggccccucgaccuggcugauuacaccuaugaccuugcagaggaagaugacagcgagccucugaacuacaaggauccaugcaaagccgcggcuuucuugggugacaucgcccucgaugaagaggaccugcgcgcauuucagguccaacaggccguugaucugcgacgucacacagcuagaaaguccucuauuaaagcagccgugcccggcaauacuucaacgccuaguugucagagcaccaacgggcagccacaaaggggagcuugcggccgguggcgcgguagauccaggucucggcgcgccgcgacaucgcgacccgaaagaguauggccugacggggugauaccauucgucaucggaggcaauuuuacuggcucacagagggcaguguuccggcaggccaugcgucauugggagaagcacaccuguguuacauuucucgagcgcaccgaugaagacagcuauauuguguucacuuacagaccgugcggguguugcaguuaugucggaaggcgggguggcgggccccaggcuaucuccauuggaaagaacugugauaaguuuggcaucgugguacaugaguuaggucacguugugggguucuggcaugaacacacacgaccugaccgcgacagacacgucucuauagugagggagaauauccaaccaggacaggaguacaacuuucugaagauggaaccccaggagguggaaagccuuggcgagaccuaugauuucgacuccauuaugcauuacgcccggaauacguuuucacgcggcaucuucuuggauacuauugucccuaaauacgaaguuaacggggugaagccacccaucggacagagaaccaggcugaguaaaggugacauagcacaagcucguaagcuauauaaaugcccggccuguggcgagacacuccaggauagcacugggaauuuuucuuccccugaguaccccaacggauauucagcgcacaugcauugcguauggcggauuagcgugaccccaggcgaaaagaucauucugaauuucacaagucuugaccuguaccgaucuagauuguguugguaugauuacgucgaggugagggacgguuucuggcgcaaggccccucuccgggggagauuuugcggcuccaaacugcccgaaccaaucguuagcaccgauucgagguuauggguggaguuccgaucuuccucaaacugggucggaaagggcuuuuucgcaguguaugaagcuaucugcgggggagacguuaaaaaggauuacggucacauucagagucccaauuacccugacgacuaucgcccaagcaaaguauguauauggcggauccaaguguccgagggcuuucacgucgggcugacguuccagucuuuugagauugaacgucaugauagcugcgccuacgacuaucucgaggugagagauggacacucagaaaguuccacucuuaucggcagguacugugguuaugagaagccggacgauauaaaaagcacaucuucacgccugugguugaaguucgucagugacgggagcauuaacaaggcuggcuuugccgugaauuucuuuaaagaaguugaugagugcucccggcccaacagaggaggcugugagcagaggugccuaaacacccuggggucuuacaaguguucgugcgacccuggauaugaacucgcaccagauaaacgacgcugugaggccgcuugcgguggcuuccugacuaaacuuaaugggagcaucacaucccccggauggccuaaagaauacccacccaacaagaauuguaucuggcagcugguggcgccgacccaauaccggauuucauugcaguuugacuucuucgagacggagggcaacgauguaugcaaguaugacuuugucgaagugagaaguggucucaccgcagauucuaaacugcaugggaaguucugcggcagcgagaaaccugaaguuaucacaucccaguacaauaacaugaggguggaguuuaagucagacaauacugucagcaaaaagggauucaaggcccacuuuuucucugacaaagaugaauguuccaaggacaacggcgggugccagcaagauugugugaauaccuuuggaaguuaugagugccagugucguagcggcuucguauuacaugacaacaaacacgauugcaaggaggcugguugugaccacaaagugacaucuacuuccgggaccauuacaucaccaaauuggcccgauaaguacccuaguaagaaagaaugcaccugggccauaagcucgacucccggacaucgcguuaagcugacguuuauggagauggacaucgaaucccagccagagugugcauaugaucaccuagaagucuucgacggccgggaugccaaagcuccugugcucgguagauuuugcggcucuaagaaacccgagccagugcuggccacagggagcaggauguuccuucgauuuuacucagacaacaguguccagcggaagggauuccaagcaucccaugcgaccgaguguggcgggcagguucgcgcugaugugaaaacuaaggacuuguauucucacgcccaguucggagacaauaacuacccgggcgguguggauugcgaauggguaauugucgcagaggaaggguacggaguggagcugguuuuucagaccuucgaaguggaggaggaaacagacugcggcuaugauuacauggagcucuuugacgguuaugauagcaccgccccuagacugggcagguacuguggguccggacccccagaagaggucuauucagcuggcgacagcgugcuuguuaaguuccacagugaugacacuaucacgaaaaagggguuucaucugcgguacacaucuaccaaauuccaagauacuuugcacucccgaaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6537 - RNA, 1467 nt, Artificial Sequence
  mRNA product Design5 comprising derived and/or modified sequence from Homo sapiens__NP_001191.1__HsBMP2 (opt3)
gggagagucccgcagucggcguccagcggcucugcuuguucgugugugugucguugcaggccuuauucaagcuuaccaugguggccggcaccagaugccugcucgcuuugcuguugccccaggucuuacugggaggggcagccggucuaguuccugagcucggcaggcggaaguucgcggcugccagcuccgggcgcccaucuucacaaccgagugacgaagugcugagcgaguuugaacuucgacuguuguccauguucggacucaaacagcgucccacaccuucuagagaugcaguagugccacccuacaugcuggaccuguauaggcggcacucgggccagccugguucaccagcccccgaucaucgccucgagagagcugcaagcagggccaacacuguccggaguuuucaccaugaagaguccuuagaggaacugccugagacgucugggaagaccacacgccgauucuuuuucaaucuuagcuccaucccaacugaagaguuuauuaccucagcugagcuucagguguucagagaacaaaugcaggacgcccugggaaacaauaguagcuuucaccauaggauaaacaucuacgagauuaucaaaccggcgacagcaaauucuaaguuccccguuacccggcuacucgauacucgucuggugaaccagaaugccucccgcugggaaucauuugacgucaccccugcugugaugagauggacagcccagggccacgcaaaccacggcuucguaguugagguggcucaucuugaagagaaacaaggggucagcaagaggcacgugcggauuagucgaucucugcaucaggaugagcacuccuggagccagauccgcccauugcucgugacguuuggacacgacgguaagggccauccccugcacaaaagagaaaagaggcaggccaaacauaagcaacggaaacgcuuaaagucgucuuguaagagacacccucuguaugucgauuucuccgacguuggguggaaugauuggauaguggcgccacccggauaccaugccuucuauugccacggcgaguguccguuuccucucgcagaccaccuuaacucaacuaaucaugcuaucguacagacccuggugaacagugucaauagcaaaauucccaaggccugcugugugccaacagaauuguccgcuaucucuaugcuauaccuggaugagaacgaaaaaguugugcucaagaauuaucaggacauggucguggaggguugcggguguaggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6538 - RNA, 1503 nt, Artificial Sequence
  mRNA product Design5 comprising derived and/or modified sequence from Homo sapiens__NP_001193.2__HsBMP4 (opt3)
gggagagucccgcagucggcguccagcggcucugcuuguucgugugugugucguugcaggccuuauucaagcuuaccaugauccccggcaacagaaugcugauggugguccuccuuugccagguucuguuagggggagccagccacgcuuccuugauuccugagaccgguaagaaaaagguggcagaaauacaaggccaugccgggggaaggcggucuggccagucacacgagcugcuacgcgacuucgaagcgacacuccugcagauguuuggucuucgacguagaccacagccgaguaaaagcgcuguaauccccgauuacaugagggaccuguaucgguugcaauccggggaggaagaggaggaacagauucauucuacuggacucgaguacccugaacgcccagccucgagagcaaauacggugaggucauuccaccaugaggagcaccuggaaaacauccccggcaccagcgagaauagugccuuucgguuccuguuuaaccucuccucuauuccugaaaaugaggucaucagcuccgcugaauuacgccuguuccgagaacagguggaucagggcccagacugggagagaggguuucacaggauaaacaucuaugagguuaugaagcccccugcagagguggucccaggacaucuuauuacacgguugcuggauacucgucuagugcaccauaauguaacccgcugggaaacauucgacguuucaccggccgugcucagauggaccagggagaaacaacccaacuacggucuggcuaucgaagucacucaccuucaccagacacggacccaucagggccagcacgugcgaauuagucgcagccugccucaagggucuggaaauugggcccaguugagaccacuccuggugacguuuggccaugaugguagggggcacgcguuaacucggcgcagaagggcaaagcguucccccaagcaucacucacagcgggcccgaaagaaaaacaaaaauuguagaaggcacagccuguaugucgacuucagugauguuggauggaacgacuggaucguggcuccuccaggcuaccaagccuuuuauugccauggcgauugucccuucccgcucgcagaccaccuuaauucuaccaaccaugcuauaguacagacacuggucaauuccgugaacagcucgauuccuaaggccugcugugugcccacugaguugucugcgaucuccaugcuauaccuggaugaguacgacaaaguugugcucaagaacuaucaggaaauggucguggaggggugcggaugucgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6539 - RNA, 1818 nt, Artificial Sequence
  mRNA product Design5 comprising derived and/or modified sequence from Homo sapiens__NP_001709.1__HsBMP6 (opt3)
gggagagucccgcagucggcguccagcggcucugcuuguucgugugugugucguugcaggccuuauucaagcuuaccaugcccggccuagggagaagggcccaguggcucugcuggugguggggacuucuguguagcugcugugguccuccaccguugcggcccccuuuaccagcugcagccgcggcugccgcaggcgggcaacugcuaggagacggcgguucccccgggcgcaccgagcagccuccacccucuccucagucaaguagcggauuccucuaccgacgucugaagacacaggagaaaagagaaaugcaaaaggaaauccuuuccgugcugggcuugccacacaggccgcggccccuccauggccugcagcagccucagccacccgcccugcgccaacaggaggaacagcagcaacagcagcaacucccuagaggggagccacccccgggaagguuaaaaucugcuccucuguuuaugcuugauuuguauaacgcacugucggccgacaaugaugaggacggugcuucagaaggcgagcggcagcagagcuggccccacgaagccgcgaguuccucucagcgccgacaaccaccucccggggcagcccauccacuaaacagaaagagccuccuggcucccggauccggcucagguggggccaguccucuuacuagcgcacaggauucugcuuuccugaaugacgccgauauggucauguccuuuguuaacuugguggaguacgacaaagaguucucaccaaggcagcggcaccauaaggaauuuaaguucaaucucagccagauuccggagggagaaguagugacggcggccgaguuucguauauauaaagauugcgucaugggcaguuucaagaaccaaaccuuucugaucucuauuuaccagguguuacaggaacaccagcaccgcgacuccgaucuguuccuccuugacacaagaguugugugggcaagcgaggagggcuggcuggaauuugauaucacugcuaccucgaauuugugggucgugacaccccaacauaacauggggcuacagcugucuguaguuaccagggacggagugcacguccauccucgggccgcuggucucgugggccgagacgggccauaugauaaacagcccuucaugguggccuuuuucaaggucuccgagguucacgugcgcacuacaagaucagcaaguagcaggcggcgccagcaauccagaaauaggucuacccagagccaggacguagcccgugugucaagugcuuccgauuacaacagcucugaacugaaaacggcgugucggaagcacgagcuuuaugucucauuccaagaccugggauggcaggauuggauuaucgcaccuaagggcuacgccgcuaauuacugcgacggugaauguaguuuuccauugaacgcccauaugaaugcaacuaaccacgccauagugcagacccucguucaucugaugaaucccgaguaugugccgaaaccuugcugugcuccaacaaaguuaaacgccaucagcguccuguacuucgaugacaacuccaaugugauucugaaaaaguaucgaaacaugguaguuagagcaugcgggugucacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6540 - RNA, 1572 nt, Artificial Sequence
  mRNA product Design5 comprising derived and/or modified sequence from Homo sapiens__NP_001710.1__HsBMP7 (opt3)
gggagagucccgcagucggcguccagcggcucugcuuguucgugugugugucguugcaggccuuauucaagcuuaccaugcacgugagaagccugagggccgcugcaccccauuccuucgucgcccucugggcgccucuuuuucuguugcggucugcuuuagccgacuucucacuggauaacgagguucacaguagcuuuauccaucgccgacuacguucccaggaaagaagggagaugcaacgggaaauucucucuauacugggccuuccacaccgcccgagaccccaucugcaggggaagcacaauucggcaccuauguucauguuggaccucuacaacgccauggcuguggaggaaggagguggcccagggggacagggcuuuucauaucccuacaaagcaguauucagcacccaggguccuccacuggccagucugcaagauucccacuuucucacagacgcugauauggugaugucuuucgucaauuuaguggagcaugacaaggaguuuuuccaccccagguaucaucaccgggaauuucgcuucgaucugagcaaaaucccugagggggaagccguuacugcggcagaguuucgaauuuacaaggacuauaucagagagagguucgauaacgaaacguuccggauuuccguguaccagguccuucaggagcacuugggacgugaaucagaccuguuucuacucgauagucgcacccugugggccagcgaggaaggcuggcuuguguucgacaucacagcuacuucuaaucauuggguaguuaacccaagacacaaucugggcuugcagcucuccguggagacccuggaugggcaaucaauaaacccgaaauuagccggacugaucgguaggcauggcccccagaauaagcagccuuuuauggucgcauucuuuaaggcuacagaggugcacuuccggagcauucgaaguaccgggucuaaacagcgcucccaaaacagaagcaagacucccaaaaaucaggaagcccucaggauggcgaacguggccgaaaauucgucuuccgaccagcggcaagcaugcaagaaacaugagcuuuaugucucauuucgcgaccugggauggcaggauuggaucauugcuccagagggcuacgccgcuuacuauugugaaggugagugcgccuucccuuugaacaguuacaugaaugcaacaaaccacgccaucguucagacccuagugcacuuuauaaacccagagacgguacccaagccguguugcgcuccuacucagcugaaugcgauuagcgugcucuauuucgacgauuccucuaacgucauccugaagaaauacagaaauauggugguuagggcaugugggugccauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6541 - RNA, 576 nt, Artificial Sequence
  mRNA product Design5 comprising derived and/or modified sequence from Homo sapiens__NP_006264.2__HsCCL7 (opt3)
gggagagucccgcagucggcguccagcggcucugcuuguucgugugugugucguugcaggccuuauucaagcuuaccaugaaggccagcgcugcacugcucugccuucuguugaccgccgcggcuuucucuccccagggcuuagcccaaccuguggggaucaacacauccacuacguguugcuacagauuuauuaauaaaaagauaccaaaacagaggcuggagucauaucggcgcaccacaaguagccacuguccgcgagaagcagucaucuucaagacuaaacuagacaaggagauuugcgccgaucccacccagaaguggguucaggacuuuaugaaacaucucgauaagaaaacacaaaccccuaagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6542 - RNA, 3900 nt, Artificial Sequence
  mRNA product Design5 comprising derived and/or modified sequence from Homo sapiens__NP_001954.2__HsEGF (opt3)
gggagagucccgcagucggcguccagcggcucugcuuguucgugugugugucguugcaggccuuauucaagcuuaccaugcugcucacccuuaucauucuguugcccguggucagcaaguucuccuuuguuucuuuaucagccccucagcacuggaguugcccagagggcacacuggcugggaacggaaauagcacuuguguggguccggcacccuuccuaauauuuucccauggcaacucuaucuucagaauugacacggaagggaccaauuacgagcaacucguaguggacgccggagucucggugaucauggacuuucacuauaacgaaaagaggauuuacuggguugaucuggagcggcagcuucugcagcgcguguucuugaauggcucacgacaggaacgugucugcaacaucgagaagaaugugagcgguauggcgauaaacuggaucaaugaggaaguaauuuggaguaaccaacaggaggggaucauuacaguuacugacaugaaaggaaauaacucccauauccuccugucugcucugaaguauccugccaauguggcagucgauccaguggaaagauuuauauucuggagcuccgagguggccggcucacucuacagggcugacuuagauggcgucgggguuaaagcacugcuugagaccagugaaaagauuacagccgugagcuuggacguacuggauaagcggcuauuuuggauccaguauaaccgcgagggaucuaauucccucauuuguucaugcgacuacgaugguggcagcgugcacaucaguaaacaucccacccagcacaaccuguucgcuaugucucuuuuuggggacagaaucuucuauuccacuuggaagaugaaaacaauuuggauagccaacaagcacaccggaaaagauauggucaggaucaaucugcauagcucguuugugccuuugggcgaacucaagguugugcacccacuggcgcaacccaaggcagaggacgacacgugggaaccugagcagaaauuauguaagcugcggaaagguaacugcucauccacugucugugggcaggaucuccagucacaucuuugcaugugugccgagggauacgcucugagucgcgaccgaaaguacugcgaagaugugaaugagugugccuucuggaaccacggcugcaccuugggcugcaaaaauacaccagggagcuauuacuguacuugcccgguaggauucguucuacugcccgacgguaagagaugucaccaacucguguccugcccuaggaacgucucugaauguagccaugauugcgugcugaccucagagggcccacuuuguuuuugccccgaagggaguguccuggagcgggacggaaaaacauguuccggcugcagcucuccugauaaugguggguguucacaguugugcgugccacucagucccguuagcugggagugcgacuguuucccgggcuaugaucugcaguuagacgaaaaguccugcgcagcuucuggaccucaacccuuucugcuauucgccaacucgcaggauauucgucacaugcauuuugacggcaccgacuacgggacgcuccugagccagcagaugggaaugguguaugcgcuugaucacgacccaguagagaauaagaucuacuucgcccauacugcauugaaauggauagaacgcgcuaacauggaugguucccaaagagagaggcugauugaagagggcgucgacgugccugaggggcucgccguugauuggaucggacggcgauuuuauuggacagaccgcggcaagucacugaucgguagaagugaucuuaaugggaaaaggucuaagauuaucaccaaagaaaacauuagccagccccggggcauagcugugcacccaauggccaagcgccuguucuggacugacacaggaaucaaucccagaauugaguccucuagcuugcagggccucgggaggcuggucaucgcaucuuccgauuuaaucuggccuaguggaauuaccauagacuuucugacggauaagcuauacuggugugacgccaaacagagcgugaucgaaauggcuaaccucgaugguucuaagcgucggcgacugacccaaaaugacguaggccacccauucgcgguggcaguuuuugaggacuacgucugguucuccgauugggccaugccgucagugaugagagugaacaaaaggacagggaaggaccgcguccggcuucagggaaguauguugaaacccagcucgcugguuguggugcauccucucgcuaagccaggcgccgaucccugccuguaucagaacggugggugugagcacauuugcaagaaaagauuaggcacugcaugguguuccugcagggaaggauuuaugaaggccucugacggcaaaaccugucuggcucuugaugggcaucaguugcucgccggaggcgagguagaccugaagaaucaagucacaccucuagauauccugagcaaaacucgcgugucagaagacaacauuaccgagagucagcacaugcucguugcagaaaucaugguguccgaucaggacgauugcgcgccagucgguuguucuauguacgcucgaugcauaagcgagggggaggacgccacaugccagugucugaagggauucgcaggcgaugguaaacuuugcuccgacaucgacgaaugugagaugggcgugcccguuugcccgccugccucaagcaaauguauuaauaccgaagggggauaugugugccgguguagugagggcuaccaaggggauggaauccacugcuuggacauugaugaaugucagcugggcgagcauucuugcggugagaacgcuuccuguacuaauacggaagggggauauacaugcaugugcgccggccguuuaagcgagccaggucucaucugucccgacucgaccccucccccacaccugagagaagaugaccaucacuacucaguaaggaacucugauagugagugcccucuuucccaugacggcuauugucugcacgauggggucugcauguacauagaagcauuggacaaguacgcuuguaauugcguggugggauauauuggcgagcgcugucaguaccgggaucucaaauggugggagcugagacacgccgggcauggacaacagcagaaggucaucguuguggcgguaugcguggucgugcuaguuaugcugcuccugcuuagcuuguggggcgcccacuauuacaggacucagaaacuguuaucuaagaaccccaaaaauccauaugaagagagcucccgagacgugcgcucacggagaccggcugacaccgaagaugguaugaguagcuguccucaacccugguucgucgugauuaaggagcaucaggaccucaagaacgggggacagccaguugcaggcgaggauggucaggccgcugacggcucuaugcaacccacauccuggaggcaggaaccucagcugugcgggaugggaaccgagcagggcuguuggaucccagugucaagugauaaagggagcugcccccaagucauggaacguuccuuucacaugccuucuuacggaacucagacacuugagggcgguguagaaaagccgcauucgcugcuaagcgccaauccacucuggcagcaacgcgcacuggaucccccucaccagauggaguugacgcagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6543 - RNA, 786 nt, Artificial Sequence
  mRNA product Design5 comprising derived and/or modified sequence from Homo sapiens__NP_001423.1__HsEREG (opt3)
gggagagucccgcagucggcguccagcggcucugcuuguucgugugugugucguugcaggccuuauucaagcuuaccaugaccgccggcagaaggauggagaugcugugcgcugggcgggugcccgcacuccuucuguguuugggauuccacuuacugcaggccguccuaagcacaacuguuaucccuuccugcauuccaggugaaucuucagacaacuguacggcgcucgugcaaaccgaggauaauccgcgcguagcucaggugaguauaacaaagugcagcuccgacaugaacggcuacugucugcaugggcagugcaucuaucuugucgauaugucucagaauuacugucgaugcgaagugggauauacuggcguucguugugagcacuuuuuccugaccgugcaucaacccuugucgaaagaauacgucgcccucacagugauucugaucauucuguuucucaucaccguaguugguucaacuuauuacuucugcagaugguauaggaaccgcaagagcaaagagccuaagaaagaguacgaacgggugacaaguggggacccagaguuaccccaggucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6544 - RNA, 744 nt, Artificial Sequence
  mRNA product Design5 comprising derived and/or modified sequence from Homo sapiens__NP_000791.1__HsFGF1 (opt3)
gggagagucccgcagucggcguccagcggcucugcuuguucgugugugugucguugcaggccuuauucaagcuuaccauggccgagggcgaaaucaccacauucacugcucugacggagaaguuuaaccuucccccugggaauuacaaaaagccaaaacuccuguauugcagcaacggaggucacuucuugagaauuuuaccggacggcaccguggaugggacaagggaccgguccgaucagcauauacaacugcagcuaucugcagaaucagucggagagguuuacaucaagaguacugaaaccggccaguaucucgccauggacacagauggucugcuuuacgggagccagacccccaaugaggagugucuguuuuuggaacgccucgaggaaaaccacuauaauacuuacauuuccaaaaagcaugcggagaagaacugguucgugggacugaaaaagaauggcucuugcaaacgaggcccucguacacacuaugggcaaaaggcuauccuguuucucccauuacccguaucgucagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6545 - RNA, 1143 nt, Artificial Sequence
  mRNA product Design5 comprising derived and/or modified sequence from Homo sapiens__NP_001997.5__HsFGF2 (opt3)
gggagagucccgcagucggcguccagcggcucugcuuguucgugugugugucguugcaggccuuauucaagcuuaccauggugggcgucgggggaggugacguugaggaugugacccccagaccuggcgggugccagaucagcggaaggggcgcccgggguuguaacgggauuccaggagcugcagccugggaagcggcucugccgcgccgacgucccagaaggcacccuuccguaaauccacggucucgcgccgcaggcucacccagaacaaggggccggcgcacugaggaacgaccuagugggagcagacucggagacaggggucggggccgugcccuuccagggggacgccugggcgguagagggaggggacgggcucccgagcgagugggcggccgcgggagaggaagggguacggcagccccucgggcugccccagcggcacgcggcuccagaccggggcccgccggaaccauggcugccggcucuauaacaacuuugccugcauuaccagaagauggugggucgggcgcuuuucccccuggacauuucaaggacccaaaaaggcuguacugcaagaacggcggguucuuucuacguauccaccccgauggacgggucgacggugugcgagagaaaucagauccgcauauuaagcuccaacugcaggccgaggaaagaggcguugugagcaucaaaggggucugugcgaauagguaucuugccaugaaggaggacggacgccuguuggcaaguaagugcgugaccgaugaauguuucuuuuucgagcggcucgaguccaacaauuacaacacauauagaucuaggaaauacaccagcugguauguagcucugaagcgcacuggccaguacaaacuggguuccaagacagggccuggccagaaagccauucucuuuuuacccaugucagcuaagaguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6546 - RNA, 861 nt, Artificial Sequence
  mRNA product Design5 comprising derived and/or modified sequence from Homo sapiens__NP_002000.1__HsFGF7 (opt3)
gggagagucccgcagucggcguccagcggcucugcuuguucgugugugugucguugcaggccuuauucaagcuuaccaugcacaaguggauccugaccuggauucuccccacacuucuguacagaagcugcuuccauauaaucuguuuggugggcacuauuuccuuagccugcaacgacaugacgccugagcagauggcuaccaaugucaacuguucuucaccagaaaggcacacacggaguuaugauuacauggagggaggagacauccgcguucgacgucuguuuugcagaacucaaugguaucuaaggauugauaaacgggguaaggugaaaggcacccaggaaaugaagaauaacuacaauaucauggagauacgcacaguagcaguggggaucgucgccauuaaaggaguggaaagcgaguucuaucucgcgaugaacaaggagggcaagcuguacgcuaaaaaggaauguaaugaggacugcaacuuuaaagaacuuauccuggagaaucauuauaacaccuacgccuccgcaaaguggacucacaaugguggggagauguucguugccuugaaccagaaagggauuccggugagaggcaagaagaccaaaaaggaacagaaaacagcucauuuucuccccauggcaaucacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6547 - RNA, 903 nt, Artificial Sequence
  mRNA product Design5 comprising derived and/or modified sequence from Homo sapiens__NP_001936.1__HsHBEGF (opt3)
gggagagucccgcagucggcguccagcggcucugcuuguucgugugugugucguugcaggccuuauucaagcuuaccaugaagcugcuccccagcgugguccuuaaacuguucuuggccgcuguuuuauccgcacuggugaccggcgagucucuagaaagacucaggcgggggcuggccgcgggaacaucaaacccugacccaccgacuguaaguacggaucagcuucugcccuuggguggcgggcgcgaccgaaaggugcgugaucuccaagaggcugaccuggaucugcucagagucaccuuaagcuccaaaccucaggcccuggcaacaccaaauaaggaggaacacggaaaaaggaagaagaaaggcaagggucuugggaaaaagcgggaccccugcuugcgcaaauacaaggauuuuuguauccauggagaaugcaaguaugugaaagagcugagagccccuucuuguauuugccacccaggcuaccauggcgagaggugucacgggcuaucgcuccccguugaaaaccggcuguauacuuacgaccauaccacaauacuugcuguggucgcagugguacugucaagcguuugcuugcucgugaucgucggacuguuaauguuccgcuaucaccgaagagguggcuacgauguggagaaugaagagaaggugaaacuggggaugaccaacagucacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6548 - RNA, 2463 nt, Artificial Sequence
  mRNA product Design5 comprising derived and/or modified sequence from Homo sapiens__NP_000592.3__HsHGF (opt3)
gggagagucccgcagucggcguccagcggcucugcuuguucgugugugugucguugcaggccuuauucaagcuuaccaugugggugaccaagcugcuccccgcccuucuguugcagcacgucuuacugcaucuacuccugcuuccuaucgcuauuccauacgcagagggccaaagaaaaaggcggaacacaauacacgaguucaagaaaagcgccaagacuacgcugaucaaaauugacccggcguugaagaucaagaccaaaaagguuaauacagcugaucagugcgccaaccgcuguacucgaaauaaagggcuccccuuuaccugcaaggcauucguguuugacaaagcccguaagcagugucugugguucccuuuuaacuccaugucuucaggaguaaagaaagaguucggucaugaauuugaucuguaugagaauaaggacuacauuagaaacugcaucauaggcaaagggaggaguuauaagggaacagugagcaucaccaaauccggcauuaagugucagccauggucuucgaugaucccccacgaacauucauuccucccuagcaguuaccgggguaaagauuuacaagagaauuauugccgcaacccaagaggggaggaaggaggccccugguguuuuacuuccaauccugaggucagguacgaagugugcgacauuccacaguguucugagguugagugcaugacauguaacggcgaaagcuaucgggggcugauggaucacaccgaguccggaaagaucugccagcgcugggaccaccagacgccgcaucgacacaaguuccuucccgaaagauacccugauaaagguuuugacgauaauuacugcaggaacccagacggccaaccccggccuugguguuauacuuuggauccacauacccguugggaauacugcgcuauaaagacaugugcagacaauacuaugaacgacaccgaugugccccuggaaacaaccgagugcauucaggggcagggagagggcuaucgcgguacggucaauacuaucuggaacgggauuccgugucagagaugggacucacaauacccucacgaacacgauaugacacccgagaacuucaaaugcaaggaccuaagggaaaauuauugucggaacccagauggaagugagagcccuuggugcuuuaccacugaccccaauauccgagugggcuacuguucucagaucccaaacugcgauaugucccauggccaggacuguuaucgcgggaaugguaaaaacuacaugggaaaucucucacaaacaagaagcggccugaccugcaguaugugggauaagaacauggaagaccuucacaggcauauuuucugggagcccgaugccucuaagcugaaugagaacuacugccggaauccugacgacgaugcucacgggccaugguguuauacgggaaacccguugauacccugggacuacugcccuaucucccgcugugaaggcgauaccacaccaacuauuguaaaucucgaccaucccguuaucagcugcgccaaaaccaagcagcugagaguggucaacgguauaccuacaaggacuaauauuggguggauggugucguuacguuaucggaacaaacacaucuguggcggaucucugaucaaggaguccugggugcucaccgcgcgacagugcuucccaucaagagaucuuaaagacuacgaagcauggcugggcauucacgauguccaugggaggggagacgagaaguguaagcagguuuugaacgugagucagcuaguauauggucccgaaggcagcgaucuggugcucaugaaacuggcccgcccggcuguccuugacgauuuuguguccacaaucgaccugccuaauuacgggugcaccauuccagagaagacuucuuguagcguuuauggauggggcuacacggguuugauaaacuacgaugggcuccugcggguggcccacuuauauaucaugggcaaugagaaaugcucacaacaucacagaggaaaggucacacugaacgaaagugagauuugugcaggcgcugagaaaaucggguccggacccugcgaaggugacuacggcgggccucuagugugcgagcagcacaagaugaggaugguacucggaguuaucgugcccggccgcgguugugccauuccaaaucgaccugggauauucguccggguggcguauuacgccaaguggauccauaaaauuauccugaccuauaaggucccccagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6549 - RNA, 2202 nt, Artificial Sequence
  mRNA product Design5 comprising derived and/or modified sequence from Homo sapiens__NP_005336.3 __HsHSPA1A (opt3)
gggagagucccgcagucggcguccagcggcucugcuuguucgugugugugucguugcaggccuuauucaagcuuaccauggccaaggcugcagccaucggcauugaccuggggaccacauacagcugcgugggagucuuccagcacgguaaaguugagauaaucgcgaacgaucaaggcaauagaacuacgcccuccuauguggcuuuuaccgacacagaaaggcucauuggggaugccgcaaagaaccagguagcccuuaauccucagaacacuguguucgacgcuaaacggcugaucggacgcaaguuuggcgauccagucgugcagucugacaugaaacauuggccguuccaaguuauuaaugauggugacaagcccaaggugcaggucucauacaaaggggagaccaaggcauuuuauccugaagagaucaguagcaugguguugacaaaaaugaaggaaauagccgaggcuuacuuaggauauccaguaaccaacgccguuaucacugugcccgcguacuucaaugauucccagcgacaggcaacaaaagacgccggcgucauugcuggccugaacgugcuacguaucauuaaugagccuaccgccgcagcuaucgccuaugggcucgauagaacgggaaagggugaaaggaacgugcugauauuugaccuuggcgggggaacuuucgaugucucuauucugaccaucgacgacggcauuuuugagguuaaggcgacagccggugauacucaccuugggggagaagacuucgauaaucggcucgugaaccauuuuguagaggaguucaaacgcaagcacaaaaaggacaucucgcaaaauaaaagagcagugaggcggcugcgcaccgcuugugaacgagccaagagaacacugucaagcaguacccaggcuucccucgagaucgauucuuuauuugaaggcauugacuucuacacgagcauaacuagggcccgguucgaggaacugugcuccgaucuuuuucguucaacauuggagccagucgagaaagcacugcgcgacgccaagcuagauaaggcucagauccaugaccucgugcugguuggcgggaguacccggauucccaaagugcagaaguugcugcaagauuucuuuaacggaagggacuugaauaaaagcaucaacccugacgaagcggucgcauacggugccgcugugcaggccgcaauacucaugggcgauaagucugagaacguacaggaccuguuacugcucgauguugccccacuuucccugggguuggaaacugcuggaggcgugaugacagcccuaauuaaaagaaauucaaccaucccgacgaagcaaacccagaucuucacaacuuauagcgacaaccagcccgguguccugauucagguguacgagggggaacgagcaaugaccaaggauaauaaccuccugggccgcuuugagcuuaguggaaucccuccagcgcccagaggcgucccucaaauugaggugacauucgacauagaugcuaaugggauccugaacguuacugccaccgacaaaucuacaggaaaggcaaauaaaauuaccaucacuaacgauaaggguagguuguccaaagaagagaucgaacggauggugcaggaggccgaaaaguauaaggcugaggacgagguacagcgcgaaagagucagcgccaaaaaugcacucgagucguacgcuuuuaacaugaagucugccguggaagaugagggccugaaagggaagauuuccgaggcggacaaaaagaagguuuuagauaaaugucaggaagugauaucauggcuggacgccaauacgcuagcugagaaggacgaguucgaacacaaaaggaaggaacucgagcaagucugcaacccaaucauuaguggacuguaucagggcgccggugggcccggcccgggaggcuuuggggcacagggaccuaaagguggcagcggguccggacccacaaucgaggaaguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6550 - RNA, 2202 nt, Artificial Sequence; identical to SEQ ID NO: 6549
  mRNA product Design5 comprising derived and/or modified sequence from Homo sapiens__NP_005337.2 __HsHSPA1B (opt3)

SEQ ID NO: 6551 - RNA, 2202 nt, Artificial Sequence
  mRNA product Design5 comprising derived and/or modified sequence from Homo sapiens__NP_005518.3 __HsHSPA1L (opt3)
gggagagucccgcagucggcguccagcggcucugcuuguucgugugugugucguugcaggccuuauucaagcuuaccauggccaccgcuaagggcaucgcaauugggauagaccugggaacaacuuacagcugcgugggugucuuccagcacggcaaaguugagaucauugccaacgaucaagggaauagaacgacccccuccuauguggcguuuacagacacugaaaggcucaucggagaugcugccaagaaccagguagcaaugaauccucagaacaccguguucgacgccaaacggcuuauuggccgcaaguuuaaugauccagucgugcaggcugacaugaaacuguggccguuccaaguuaucaacgagggugggaagcccaagguguuggucucuuacaaaggagaaaauaaggcauuuuauccugaggaaauaucaaguaugguguuaacaaaacugaaggagaccgccgaggcuuuccuaggccauccaguaacuaacgccguuaucacagugcccgcguacuuuaaugauagccagcgacaggcaaccaaagacgccggcgucauugcugggcucaacgugcugcguaucauuaaugaaccuacggccgcagcuaucgccuauggacuugauaaggguggccagggggagagacacgugcugauauucgacuugggaggcgguacuuuugaugucuccauucucaccaucgacgaugggauuuucgaaguuaaggcgacagccggagacacucaucugggcggcgaggacuuugauaacaggcuggugucucacuucguagaggaauuuaaacggaagcauaaaaaggacaucucgcaaaauaaacgcgcagugagaaggcuccggaccgcuugugagcgcgccaagcgaacauuaucaagcaguacccaggcuaaccuggaaaucgauucccuuuacgaggggauugacuucuauacgucuauaacuagagccagguucgaagaguugugcgcagaucuguuucggggaacacuagagccagucgaaaaagcccuccgugacgcuaagauggauaaggcgaaaauccacgacauugugcugguugguggcagcacccgcauccccaaggugcagagacuucugcaggauuacuucaaugggagggacuugaacaaauccauaaacccugaugaggcagucgccuacggagcugccgugcaagcagccauucucaugggcgacaagucagaaaaaguacaggaccuguuacugcucgauguugcuccacuuagucuggguuuggagacugccgggggcgugaugacagcacuaaucaagcggaauagcaccaucccgacgaagcagacccaaauuuuuacaacuuauucugacaaccagcccggaguccugauccagguguacgaaggcgagcgagcgaugaccaaagauaauaaccuccuggggcgcuucgaccuuacagggauuccuccagcucccagaggugucccucagauagaggugacuuuugauaucgacgccaauggcauucugaacguuaccgcaacagauaaguccaccgggaaagugaauaagaucacuaucacgaacgacaaaggaagguugucaaaggaagagauugaacggaugguacucgaugccgagaaguauaaagcugaagacgagguccaacgcgagaagauagccgcuaaaaaugcacuggaaagcuacgccuucaacaugaagagugugguuucugaugagggcuuaaaagguaagaucuccgaaagcgacaagaauaaaauucuggauaaguguaacgagcuacucucguggcuggaggugaaucagcuugcggaaaaagacgaguuugaccacaagagaaaagaauuggagcagaugugcaacccaaucauuacaaagcuguaucagggaggcuguaccggacccgccugcggcacuggguacgucccgggaaggccugcuaccggucccacaaucgaagagguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6552 - RNA, 2196 nt, Artificial Sequence
  mRNA product Design5 comprising derived and/or modified sequence from Homo sapiens__NP_068814.2 __HsHSPA2 (opt3)
gggagagucccgcagucggcguccagcggcucugcuuguucgugugugugucguugcaggccuuauucaagcuuaccaugagcgccagaggccccgcuaucgggauugaccugggaaccacauacuccugcgugggugucuuccagcacggcaagguugagauaaucgcaaacgaucaagggaauaggacuacgccuucuuauguggccuuuaccgacacagaacggcucauuggagaugcggcuaaaaaccagguagccaugaauccaacuaacaccaucuucgacgcaaagcgccuuauuggccgaaaauuugaggaugccacagugcagucagacaugaagcauuggccguuccgugucgugagugaaggugggaaacccaagguucagguggaguacaagggagaaaccaaaacauuuuucccugaggagaucagcuccaugguccugacuaagaugaaagaaauagcugaggcauauuugggcggcaaggugcacucugccguaaucaccguuccagcuuacuuuaaugauucgcaaagacaggccacgaaagacgcggggacuauuaccggauuaaacgugcugaggaucauuaaugaacccacagcagccgcuaucgccuauggucuagauaagaagggcugugcagggggagagaaaaacguccucauauucgaccugggcggugggacuuuugaugugucaauucuuaccaucgaggacggaauuuucgaagucaagagcacagcuggcgauacccaucugggcggggaggacuuugacaaucggauggugagucacuuggccgaagaguucaaacgcaagcauaaaaaggauaucggaccuaacaaaagagcgguuaggcggcuccgcacggccugcgaacgagcaaagagaacucuguccucuagcacacaggcuuccaucgagauugacucacuguacgaggguguggauuuuuauaccaguauaacuagggcccgguucgaggaacucaaugcugacuuauuccguggcacacuggaaccaguagagaaggcccuucgcgaugcaaaauuggacaaggggcagauccaagaaauugugcuggucggaggcagcaccagaauccccaaaauacagaagcuacuccaggacuuuuucaacgguaaagagcugaauaagucuauuaacccugaugaggccguggcuuacggggcggcaguucaggccgcuauccuuaucggcgauaaguccgaaaaugugcaagaccuguugcuccuggaugucacgccauuaucacugggaauugagaccgccggcggggugaugacaccgcucaucaaaaggaacacuaccauucccacaaagcagacucagaccuuuacaaccuacagcgacaaccaaaguucuguacuuguucagguguaugaaggagagcgggcaaugacuaaagacaauaaccuguuggguaaguucgaucuaacgggcauaccuccagcuccccgaggggucccucagaucgaagugacauuugacauugaugccaauggaauccugaacgucaccgccgcagacaaauccacuggcaaggagaauaagaucaccauuacaaacgauaaaggucgccucagcaaggacgauauagacagaauggugcaggaggcggaaagguacaaaucggaggaugaagcuaaucgggaccgcguugccgcaaagaacgcccuggagucuuauaccuacaauaucaaacaaacuguggaggaugaaaaacuuagagggaagauuuccgagcaggacaagaacaagauccuggauaaaugucaggaaguaauuaauugguuggacaggaaccagauggcugagaaggacgaauaugagcacaaacaaaaggagcucgaacgugucugcaauccaaucauaucaaaacuguaccagggcggacccggcgggggaagugguggcgggggaagcggcgccuccggugggccgacaaucgaggaaguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6553 - RNA, 2799 nt, Artificial Sequence
  mRNA product Design5 comprising derived and/or modified sequence from Homo sapiens__NP_002145.3 __HsHSPA4 (opt3)
gggagagucccgcagucggcguccagcggcucugcuuguucgugugugugucguugcaggccuuauucaagcuuaccaugagcguggucggcaucgaccugggguuccaguccugcuacguugccguggcuagagcaggagguauugagaccauagccaacgaauauucugauagguguacacccgcgugcaucucauuuggcccuaagaaucggaguauuggggcugccgcaaaaagccaaguaaucuccaacgccaagaauacugugcagggauucaaacgcuuucacggccgagcuuucucugacccauuugucgaggcagaaaagucgaaccucgccuacgauauugugcagcuuccgacgggucugaccgggaucaaaguuacauauauggaggaagaacguaauuucacuaccgaacaggugacagcuauguuguuaucaaagcugaaggaaaccgccgagagcguccucaaaaagcccgugguagacuguguugugagugucccuugcuuuuacacugaugcggaaagaagguccgugauggacgcaacacaaauagccggacuaaacugucugcggcuuaugaaugagaccacggcuguggcccuggcauauggcaucuacaaacaggauuugccagcucucgaggaaaagccccgcaacgucguuuucguggacaugggccauucugccuaucagguaagcgugugcgcguuuaauagagggaaacugaagguccuggccacugcauucgauaccacacucggagguaggaaguuugacgagguguuaguuaaccacuucugugaagaguuuggcaaaaaguacaaacuggauauuaaguccaaaauccgggcucuuuugcgccugucacaggaaugcgagaagcucaaaaagcuaaugagugccaaugcuagcgaccugccucuuucuauugaguguuucaugaacgauguggacgucuccgggacuaugaaucgaggaaaguuccuggaaaugugcaacgacuugcucgccagaguggagccaccccugaggucaguauuagaacaaaccaaacugaagaaagaggauaucuacgcaguugaaauagugggcggugccacacggauuccugcugucaaggagaaaaucagcaaguuuuucgggaaggagcucaguaccacgcuuaaugcggacgaagcagugacucguggaugugcccugcagugcgcuauuuugucuccagccuuuaaaguccgcgaguucuccaucacagaugugguuccguaucccaucagccuaagauggaacucgccugcagaagaggggucuuccgacugcgaaguguuuucaaagaaccaugccgcuccauucaguaaaguacugaccuuuuacaggaaggagcccuucacucucgaggccuauuacagcuccccucaggaucugccauaucccgacccggcaauugcgcaguuuucuguccaaaaagugacaccucagagcgauggcucaaguuccaagguuaaggugaaaguccgggugaauguacacggcauauucagcgugucuucagcuagucuuguugaaguccauaagagcgaggaaaacgaggagcccauggaaaccgaccagaaugccaaagaggaagagaagaugcaaguggaucaggaggagccacacguggaggaacagcagcaacagacgccugcagagaacaaagccgaauccgaggaaauggagaccucucaggcuggaucgaaggacaagaaaauggaucagcccccacaagccaagaaagcaaaggucaaaacaagcacuguugaccugcccaucgagaaucaguugcucuggcagauugaccgagaaaugcugaacuuauacaucgagaaugaagguaagaugauaaugcaggauaaacuggagaaggaacgcaacgacgcuaagaaugccguggaggaguauguguacgaaaugagagauaaacuauccggcgaguacgaaaaguuuguaucagaggacgauaggaacaguuucacccucaaacuggaggacacagaaaauuggcuuuaugaggauggggaagaccaaccuaagcaggucuacguggauaaauuggcggagcugaagaaccucggacagccaauuaagauccgguuucaggaaucugaggagcgcccgaaacuguucgaggagcuuggcaagcaaauccagcaguauaugaaaauuaucagcuccuucaagaauaaagaagaccaauacgaucaccuggacgccgcugauaugacuaagguugagaagucaaccaacgaagcaauggaguggaugaauaacaaauugaaccuccagaauaagcagagccugacaauggaccccguggucaaaucuaaggagauugaagccaaaauaaaggaguuaaccuccacuuguaguccuaucauuagcaagccaaaacccaagguggaaccuccaaaagaggaacagaagaacgcugagcaaaauggucccguugacgggcagggcgauaacccgggaccucaggccgcagagcagggcacggacacagcggugccaucugauuccgacaaaaagcugcccgaaauggauaucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6554 - RNA, 2796 nt, Artificial Sequence
  mRNA product Design5 comprising derived and/or modified sequence from Homo sapiens__NP_055093.2 __HsHSPA4L (opt3)
gggagagucccgcagucggcguccagcggcucugcuuguucgugugugugucguugcaggccuuauucaagcuuaccaugagcguggucggcaucgaccugggguuccucaacugcuacauugccguugcuagauccggagguauagagaccaucgcaaaugaauauucugauagguguacacccgccugcauuucacuuggcagucggacucgcgcgaucgggaacgcugccaagagccagauugugacgaauguacgaaacaccauccacggauuuaaaaagcugcauggccguuccuucgacgauccuauagugcaaacagagagaaucagguugccauacgaauuacagaaaaugccgaaugguucugcaggggucaaggugcgguaucuggaggaagagagacccuuugccauugagcagguuacuggaaugcuacucgcuaaacugaaggaaaccucggagaacgcacuuaagaaaccuguggccgacugugucaucucaauucccagcuucuuuacagaugcugaaagaaggagugugauggccgcggcacagguagccggccugaauugcuugcggcucaugaacgagaccacugcuguugcccuggcauacggcaucuauaagcaagaccugccaccucucgaugagaaaccacgcaauguggucuucauagacauggggcacuccgcuuaccagguguuagugugugccuuuaacaagggaaaacugaagguccuugcgacaaccuucgaucccuauuuggguggccgaaauuuugacgaagcccugguugauuacuucugcgacgaguuuaagacgaaauacaagauuaacgugaaagaaaauucuagagcacuacucaggcuguaucaggagugugaaaaacuuaagaagcugaugagcgcuaacgccuccgauuugccucucaauaucgagugcuucaugaacgaccuggacguaucaaguaaaaugaaccgggcucaguuugagcaauuaugugccagccugcucgcacguguggaaccaccgcuuaaggccgucauggagcaggcuaaucugcagcgcgaagauauuucuuccaucgagaucguugggggagcgacucgcauucccgcagugaaggaacagauaaccaaauucuucuugaaggacaucucaacaacucuaaacgccgaugaggcuguggccaggggcugcgcacugcaaugugccauucucagcccugcuuuuaaaguccgggaguucaguaucaccgaccuggugccauacucuauaacacuucgauggaagaccuccuuugaagaugguagcggggagugcgaaguauucugcaaaaaucaucccgccccuuuuucgaagguuauuacguuccacaagaaagagccauuugaacuggaggcauucuauacuaacuugcaugaggugcccuacccggacgcgcgcaucggaucuuuuacaauccagaaugucuucccucaguccgauggcgacucaaguaaggugaaagucaaggugagaguuaacauucacggcaucuuuagcguggcuuccgccucuguaauugaaaaacaaaaucucgagggggaucacagcgacgcacccauggaaaccgagacuucauucaagaacgagaauaaggauaacauggacaaaaugcaggucgaccaggaagagggacaucagaagugucacgccgaacauacaccagaggaagagauagaucacaccggugcuaaaacgaagagugccguguccgacaaacaagauaggcugaaucagaccuuaaagaagggcaaaguuaagagcaucgaccugccuauucagucuucacuaugccggcagcucgggcaagaucugcuuaacaguuauaucgagaaugaaggaaaaaugaucaugcaggacaaguuggagaaagaacgcaacgaugcaaagaaugcuguggaggaauacgucuaugacuuuagagauaggcugggcacaguguacgagaaauucauuacucccgaggaccucagcaagcuguccgccguacuugaagauaccgagaacuggcuguacgaagacggugaggaucagccaaaacagguguauguugacaaguugcaagaacucaagaaauacgggcagcccauacagaugaaguauauggagcacgaggaacguccuaaagcgcugaacgacuuaggcaagaagauccagcuggucaugaaagugauugaggccuaccggaauaaggaugaacgauaugaccaucuagauccaacagagauggagaaaguggaaaaguguaucucugacgcuaugucguggcucaacagcaaaaugaaugcacaaaacaagcugucccuuacucaggauccggucguuaaggugucagagauuguggccaaaaguaaggaauuggacaauuucugcaaccccaucauauacaaaccuaagccaaaagcugagguacccgaagauaagccuaaggccaauucugagcacaacggaccaauggacggccagagcgggaccgagacaaaauccgauucaaccaaggacagcucucaacauacuaaauccaguggagaaauggaggucgauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6555 - RNA, 2241 nt, Artificial Sequence
  mRNA product Design5 comprising derived and/or modified sequence from Homo sapiens__NP_005338.1__HsHSPA5 (opt3)
gggagagucccgcagucggcguccagcggcucugcuuguucgugugugugucguugcaggccuuauucaagcuuaccaugaagcugagccucguggccgcuaugcuucuguuguuauccgcagccagagcggaggaagaggacaaaaaggaagaugucggcaccguuguggggaucgaccugggaacaacuuacucuugcguagguguguucaaaaacggcagggucgagauuauagcuaaugaucaggggaaccggaucacgcccucauauguggccuuuaccccugaaggagagcgccuaauuggcgacgcagccaagaaucaacucacaaguaacccagagaauacuguuuucgaugcuaaacgacugaucggucguaccuggaacgacccgagcgugcagcaggauauuaaguuucuucccuucaaggucguggaaaagaagacaaaaccuuacauccagguagacauagggggaggccaaaccaagacuuuugcaccagaggaaaucuccgccaugguucugacaaaaaugaaggagaccgcugaggccuauuugggcaagaaagugacgcacgcggucgugacugugcccgcauacuucaaugaugcccagagacaggcuaccaaggacgccgggacaauugcaggacucaacgucaugaggaucauuaaugaaccuacugcugccgcgaucgccuauggucuggauaaacgggagggcgaaaagaacauacugguuuuugaccucgggggaggcaccuucgaugugucuuuacugacaauugacaaugguguauuugagguggucgcaaccaacggggacacgcaucuuggaggcgaagauuucgaccagcgcgugauggagcacuuuaucaaauuguacaagaaaaagacuggcaaggauguuagaaaagacaauagggcugugcaaaagcugcggcgcgaggucgaaaaagccaagcgagcucuaucgucacagcaucaggccagaauugagaucgaaucuuucuaugagggggaagauuuuagugagacacucaccagggcaaaauucgaggaacugaacauggaccuuuuccgguccacuaugaagccagugcagaagguacuggaggauucugacuugaaaaagagcgauaucgacgaaauuguucucgugggagguuccacacguauacccaaaauccaacagcuggucaaggaguuuuucaauggcaaagaaccuucacgcgggauuaacccagaugaggccguggcuuacggagcggcaguccaggccggcguguuaaguggugaccaagacaccggggaucugguucuccuugacguguguccgcugacguugggcaucgagaccguaggaggcgucaugacaaagcuaauacccagaaacacugugguuccuaccaagaaaagccagauuuuuagcacagcuuccgauaaucagccaacugugaccaucaaggucuacgaaggggagaggccccugacaaaagacaaccaccuccugggaaccuucgaucuuacugguaucccuccagcaccccggggcgugccgcagauugaaguaacguuugagaucgacgugaaugggauucugcgaguuacagccgaggauaagggaaccggcaacaaaaauaagauaacuaucaccaacgaccaaaaucgcuugacaccugaagagauugaaagaauggucaacgaugccgagaaguucgcugaagaggacaaaaagcucaaagagaggaucgauacccggaaugaacuggagucauaugccuacagcuuaaagaaccagaucggugacaaagaaaagcuagggggcaaacugaguucugaggauaaggaaacuauggagaaggcaguggaggagaaaauugaauggcucgaaucccaucaggacgcggacauagaggauuuuaaggcuaaaaagaaagaacuggaggagaucgugcagcccauuaucagcaaacuuuauggaucggccggcccaccucccacaggggaagaggacacggcagaaaaggaugaguugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6556 - RNA, 2208 nt, Artificial Sequence
  mRNA product Design5 comprising derived and/or modified sequence from Homo sapiens__NP_002146.2__HsHSPA6 (opt3)
gggagagucccgcagucggcguccagcggcucugcuuguucgugugugugucguugcaggccuuauucaagcuuaccaugcaggcccccagagagcuggcugugggcaucgaccucgggaccacauacagcugcgucggaguuuuccaacaggguaggguggaaauucuugcaaacgaucagggcaaucggacuacgccuuccuauguagccuuuaccgacacagagcgccuggugggggaugcggcuaagucucaggccgcauugaacccacacaauacugucuucgacgccaaacgauuaauaggacguaaguuugcugauaccacagugcaaucagacaugaaacauuggccguucagaguugugagugaaggcgguaagcccaaagucaggguguguuaccgcggggaggauaagaccuuuuauccugaagagaucagcuccaugguacugucuaagaugaaagagacugcagaagccuaccuaggacagccaguuaagcacgcugugauuacaguccccgccuauuucaacgacucgcagcggcaggcgaccaaagaugcaggcgccaucgcuggccucaaugugcugagaauuaucaacgagccuacggccgcagcuauagccuacgggcuugacaggcggggagcgggugaacgcaaugugcugaucuuugauuugggcgggggaacuuucgacgucucaguucucagcauugaugccggcguguuugagguaaaggcaaccgcuggugacacacaucucgggggagaggacuucgauaaccgacuggugaaucacuuuauggaagaguucagaaggaaacauggcaaggaccugaguggcaacaagcgggccuuacgucgccugagaacugcuugcgaaagggccaaacggacccuuuccucuagcacacaagcaaccuuggagaucgauucccuguuugaaggggucgacuucuauacgucaauuacucgagcccgcuucgaggagcuauguagugaucucuuuagaagcacacuggaaccaguggagaaggcucuuagggacgcgaaacuggauaaggcacagauccacgacguuguguuggucggagguucuacccggauacccaaagugcagaagcuccugcaggauuucuuuaauggcaaagaauuaaacaaguccauuaauccugacgaggccguagcuuacggggccgcaguucaagccgcugugcugaugggagauaagugcgaaaaaguccaggaccuccuucuguuggacguggccccacuaucacugggccucgagacugccgguggggucaugacaacccugauccagcgcaacgcgacgauuccgaccaagcaaacacagacuuucaccacauacagcgauaaucagcccggcguguuuauccagguuuaugagggagaaagagcuaugacuaaagacaacaaccuucugggcagguucgaguugagugggaucccuccagcaccccguggagugccucaaauugaaguaaccuuugauauagacgcaaaugguauccucucugucacagccaccgaucgguccacuggcaaggcuaacaaaauuacgaucacaaaugacaaggggcgacugagcaaggaggaaguggagagaaugguucacgaggccgaacaguacaaagcagaggaugaagcucagagggaccgcguggccgcgaagaacucguuagaggcccaugucuuccacgugaaaggaucucugcaggaggaaucccuacgggauaagauaccagaggaagacagaaggaaaaugcaagauaagugucgcgagguacucgcuuggcuggaacauaaucagcuugcagagaaggaggaauaugagcaccagaaacgagaauuggagcagauuugccggcccaucuuuucacgucuguacggcgguccgggggugccuggcggaaguagcuguggcacccaagccagacagggggaccccuccacuggaccaaucauugaagagguugauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6557 - RNA, 1380 nt, Artificial Sequence
  mRNA product Design5 comprising derived and/or modified sequence from Homo sapiens__P48741__HsHSPA7 (opt3)
gggagagucccgcagucggcguccagcggcucugcuuguucgugugugugucguugcaggccuuauucaagcuuaccaugcaggcccccagagagcuggcugugggcaucgaccucgggaccacauacagcugcgucggaguuuuccaacaggguaggguggaaauucuugcaaacgaucagggcaaucggacuacgccuuccuauguagccuuuaccgacacagagcgccuggugggggaugcggcuaagucucaggccgcauugaacccacacaauacugucuucgacgccaaacgauuaauaggacguaaguuugcugauaccacagugcaaucagacaugaaacauuggccguuccagguugugagugaaggcgguaagcccaaagucagaguguguuacaggggagaggauaagaccuuuuauccugaagagaucagcuccaugguacugucuaagaugaaagagacugcagaagccuaccuagggcagccaguuaagcacgcugugauuacaguccccaccuauuucucgaacucacagcggcaagccacgaaagacgcgggcgcaaucgccggccucaaggugcugccuauuaucaaugaggcuacugccgcagcuauagccuacgggcuugaucgcagaggagcggguaaaaggaacgugcugaucuuugacuugggcgggggaaccuucgaugucagcguucucaguauugacgccggcguguuugaaguaaaggcaacagcuggugauacucaucuugggggagaggacuucgacaaucggcuggugaaccacuuuauggaggaguuccgccgaaagcauggcaaagaucucuccggcaauaagagagccuuaaggcggcugcguaccgcuugcgagcgcgccaaaagaacaccaucuagcuccacccaggcaacgcuugaaaucgacucauuguuugagggggucgauuucuauaagaguauuacuagggcccgguucgaagaacuguguagcgaccuauuucgaucuacacucgagcccguggaaaaagcucugcgcgaugcgaagcuggacaaagcacagauccacgauuucguucugggagguggcuugcacucccauccucagggggccgagguggcugccggacuccugcaaagacagggcgcagaacaggagcaccaaccaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6558 - RNA, 2217 nt, Artificial Sequence
  mRNA product Design5 comprising derived and/or modified sequence from Homo sapiens__NP_006588.1 __HsHSPA8 (opt3)
gggagagucccgcagucggcguccagcggcucugcuuguucgugugugugucguugcaggccuuauucaagcuuaccaugagcaagggccccgccguggggaucgaccugggaaccacauacuccugcgucgguguuuuccagcacggcaaaguggagauuauagcuaacgaucaagggaauagaacuacgccuucuuauguagcauuuaccgacacagaaaggcucaucggagaugccgcgaagaaccagguggcuaugaauccaacuaacaccgucuucgacgccaaacggcuuauuggccgccgauuugaugacgcagugguucagucagauaugaagcauuggccguucaugguggucaaugacgccggucgucccaaagugcagguagaguacaagggggaaacaaagaguuuuuauccugaggaaguuagcuccauggugcugaccaaaaugaaggagaucgcugaggcauacuugggaaaaacugucacaaacgccguggugaccgucccagcuuauuucaaugauucucaaagacaggccacgaaggacgcgggcacuauugcaggcuuaaacguucugaggaucauaaaugaacccaccgccgcugccaucgcauacgggcuagauaaaaaggugggagcugagcggaacguacucauuuuugaccuggguggcgggacauucgaugugucgauccuuacuauugaagacggaaucuuugaggucaagucaaccgccggcgacacacaccuggguggggaggauuucgacaaucgcauggugaaccauuuuauagcggaauuuaaaagaaagcacaaaaaggauauuagcgagaauaaaagggccguucggcgcuugcgaaccgcaugugaaagagcuaagaggacgcucaguuccucuacucaggccagcaucgagauugacucccuguaugaaggaaucgauuuuuacacaucaaucacccgggcucguuucgaggagcugaacgccgaccucuuccgcggcacuuuagauccuguggaaaaagcacugagagacgccaaacuugauaagagucagauucaugacauagucuuggugggcgggagcacaaggaucccaaagauucaaaagcugcuacaggauuucuucaauggaaaagagcucaacaagucuaucaaccccgacgaagcuguagcguacggugcagccguucaggcugccauacuguccggcgacaaaucagagaaugugcaggaucuucuguugcucgacgucaccccucugagcuuagggauugaaacggcaggaggcgugaugaccguccugaucaagcggaacacaacuaucccaaccaagcaaacacagacuuuuaccacauauagugauaaucagccgggugugcucauucaaguuuacgagggggagcgagccaugaccaaagacaacaaucuucugggcaaguucgaauugacuggaaucccucccgcuccacgcggcgugccccagauugagguaacguuugauauagacgccaacgggauccuaaaugucucugcaguggauaaauccacaggaaaggaaaacaaaauuaccaucacuaaugacaaggguagacugagcaaggaggauaucgaaaggaugguucaggaggcggagaaauauaaggcugaagacgagaaacagcgggauaaggugucgucuaaaaacucccucgaaucauacgccuucaauaugaaggcaaccgucgaggacgagaagcugcaaggcaaaauuaacgaugaagacaagcagaaaauacuugacaagugcaaugagaucauuaacuggcuggauaaaaaucagacagccgaaaaggaggaauuugagcaccagcaaaaagaguuggaaaagguguguaacccuaucauuaccaagcucuaucagagugcugggggaaugccaggcgguaugcccgggggcuucccgggaggcggggccccucccagcggaggugcauccucuggcccaacuaucgaggaaguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6559 - RNA, 2316 nt, Artificial Sequence
  mRNA product Design5 comprising derived and/or modified sequence from Homo sapiens__NP_004125.3 __HsHSPA9 (opt3)
gggagagucccgcagucggcguccagcggcucugcuuguucgugugugugucguugcaggccuuauucaagcuuaccaugaucagcgccuccagagcugcagccgcgaggcuggugggcgcugccgcaucucgggggcccaccgccgcucgccaccaggacucauggaacggacucagucaugaggcauuccgacuugucagccguagagauuacgccuccgaagcuauuaagggugccguugugggcauagaccuggggacaacuaauucuugcguagcggugauggagggaaaacaagcaaaggucuuggaaaacgccgagggcgcuaggacgaccccuucggugguugccuuuacagcagauggugaacgguuaguggggaugccagcuaaacgccaggccgucacuaauccgaacaauaccuucuaugcgacaaagagacugaucggaaggcgguacgacgaucccgaggugcagaaagacauuaagaacguaccuuuuaagaucguucgcgccucaaauggcgaugcauggguggaggcucacggcaaacuauauagcccaagucagauuggggccuucguccucaugaagaugaaagaaaccgcugagaacuaccugggacauacugccaagaaugcagugaucacagugcccgccuauuuuaacgacucccaacgacaggcuaccaaagaugcgggucagauaucuggccuuaauguccugagaguuaucaacgaaccuacggcagccgcuuuggccuacgggcucgacaagagcgaggauaaggugauugcaguauaugaccugggaggcgguacuuucgauaucuccauucuggagauccagaaagggguguuugaagucaagucaaccaauggagacacauuccucggcggcgaggacuuugaucaagccuuacugaggcacauagugaaagaguucaagcgggaaacugggguugaccuuaccaaagauaacauggcuuugcagcgugugcgcgaagccgcagagaaggcgaaaugugagcugaguagcucuguccagacagacauuaaucuaccauaccucaccauggauuccucaggacccaagcaucugaacaugaaguugacgagagcucaguuugaagguaucgugacugaccugauuaggcggacaaucgccccuugccaaaaagcaaugcaggaugccgagguaagcaagagugacaucggcgaaguuauuuuggucgggggaaugacccgaaugccaaaagugcagcaaacugugcaggaucucuucggccgcgcuccgucuaaggccgucaaccccgacgaggcaguggcuauaggugccgcgauccaagggggcguucuggccggagaugugacagacguauuacugcucgacgucaccccucuuucccugggcauugaaacgcuugggggaguguuuaccaaacuaaucaauagaaacacaacuauaccaaccaaaaagagccagguuuucucgacagcugcagauggucagacucagguggagauuaaggucugucagggcgagagggaaauggccggggacaauaagcugcucggacaguucacccugaucggcauucccccugcuccacggggugugccccaaaucgagguaacauuugauaucgacgccaacgggauugugcacguuucugcaaaagauaagggcaccggacgcgaacagcagauagucauccaguccucaggcgggcuuaguaaagacgauauugagaauauggugaagaacgcggaaaaguacgccgaggaggacagaaggaaaaaggaacguguggaggcugucaauauggccgaaggaaucauccacgauacugagacgaaaauggaggaguucaaggaccaacugccggcagaugaaugcaacaaauugaaggaagagauuagcaagaugcgggaacuccuggcucgaaaagacuccgagacaggugagaauauaagacaggccgcaucuagcuuacagcaggccucacugaagcuauuugaaauggcuuauaaaaagauggcgagugagagggaaggcuccgggagcucuggaaccggcgagcaaaaagaagaucagaaggaggagaaacagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6560 - RNA, 2304 nt, Artificial Sequence
  mRNA product Design5 comprising derived and/or modified sequence from Homo sapiens__NP_079291.2__HsHSPA12A (opt3)
gggagagucccgcagucggcguccagcggcucugcuuguucgugugugugucguugcaggccuuauucaagcuuaccauggccgacaaggaggcuggcgggagcgauggacccagagaaaccgcaccuacauccgccuacucuucaccagcgaggagucugggugacacuggcaucacgccgcucagccccucccacauugugaacgauaccgacucuaaugucucggagcagcaaucauuccuuguugugguagcuguggauuuugggacaacuagcaguggauaugccuacuccuucaccaaagaaccugagugcauacaugucaugcggcgcugggaaggcggugacccaggggugucuaaccagaagacacccaccacuauccuguugacaccugagcgaaaauuucacagcuucggauaugcagcccgugauuuuuaccaugacuuagauccaaaugaggcuaagcaguggcuguaucuagaaaaauucaagaugaagcuccacaccacgggcgaccugacuauggauaccgaccuuacagcagccaacggcaaaaagguuaaagcucuggagauuuuugccuacgcguugcaguauuucaaggaacaagcacucaaagagcuguccgaucaggccgggucagaguuugaaaauagugacgugagaugggucaucacugugcccgcuauuuggaagcagccugccaagcaguucaugaggcaagcagcuuaccaggccggacuggcgagcccagagaacucugaacagcucaucauagccuuagagccggaagcagcuuccaucuacugucggaaacugcgccuucaucagaugauugaguugucaagcaaggccgcuguaaaugguuauaguggcucugacaccguuggggccggauuuacacaagcaaaagagcacaucagaaggaaccggcagucccgcaccuuccugguggaaaaugucauuggcgagaucuggagcgaacuagaggaaggugauaaguacgugguggucgacuccgggggaggcacgguugaucucacugugcaccagauacgacugcccgagggccaucuuaaagagcuguauaaggccacagggggaccuuacgguucuuugggcguagacuaugaauuugagaaacuccuguacaagauuuucggggaagauuucaucgagcaauuuaagauuaaaagaccagcugcguggguggacuuaaugaucgcauucgaauccaggaagcgggccgcugcccccgaucguaccaacccucugaauaucacucucccauuuucauucauugacuauuacaaaaaguuucgcggacacagugucgagcaugcacuuagaaaaagcaacguggauuucguuaagugguccucucagggcaugcugaggaugagccccgacgccaugaaugcuuuguuuaagccgacaauagauucaaucauugagcaccuacgggaccuguuccagaaaccugaagugaguaccgucaaguuucucuuccugguggguggguuugccgaggcaccccuucugcagcaagcgguacaggcugccuucggcgaccagugccgaaucauaauuccacaggauguuggauugacgauccucaaaggcgcagugcuguuuggguuagacccugccgucaucaaggugcgcagaucgccccugaccuacggagucggugugcuaaacagguauguugaaggcaaacacccacccgagaagcuccuggugaaggaugggacacggugguguacugacguauucgauaaauucauuagcgcugaccaaucugucgcccuuggagaguuggugaagcgcucauacaccccugcaaaaccaagucagcugguuaucgugauuaauauauauagcuccgaacaugauaacgucucuuuuaucacagacccgggcgugaagaaaugcgguacucucagacuggaucuuaccgggacaucgggcaccgcuguacccgccaggcgugagauucagacucugaugcaguucggagacacggaaaucaaggcgacagccaucgauauugcuaccagcaaguccgugaaaguuggcauagacuuuuugaacuacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6561 - RNA, 2337 nt, Artificial Sequence
  mRNA product Design5 comprising derived and/or modified sequence from Homo sapiens__NP_443202.3 __HsHSPA12B (opt3)
gggagagucccgcagucggcguccagcggcucugcuuguucgugugugugucguugcaggccuuauucaagcuuaccaugcuggccgugcccgagaugggccuccaggggcuuuacaucggaagcuccccugaaagaucuccagucccgucacccccugguaguccaaggacccaagagagcugcggcauugcuccccugacaccuucccagucuccaaagcccgaaguucgggcaccucagcaggccucguucucagugguaguggcgauagacuuugggacuacgagcaguggauaugcuuucuccuuugccucugauccagaggcaauccacaugaugcgcaaaugggaaggcggugacccgggggucgcccaccaaaagacccccacauguuuguuacugacuccugagggagcuuuccacagcuuuggcuacaccgcacgagauuauuaccaugaccuagauccagaggaagcccgugacuggcucuauuucgagaaauuuaagaugaaaauucacuccgcuacagaucugacccuuaagacucagcuggaagccgugaacggcaagacaaugcccgcguuggagguuuucgcacaugcccucagauuuuucagggagcacgcucugcaggaacugcgggagcagucaccuagucucccagaaaaagacaccgugcgcugggucuuaacggugcccgccaucuggaagcaaccggcaaaacaguuuaugagagaggcugccuaccuggcggggcuuguaagcagggaaaaugccgagcaguugcugauugcacuagagccugaagcugccucuguuuauugccggaagcuccgccugcaccagcuucuggauuuguccggacgagcucccgguggcgggagacucggagagaggcggucaaucgacagcaguuuccgucaagcccgcgaacagcugagaaggucucggcauucccgaaccuuuuuaguggagagcggcgucggugaacugugggcagagaugcaggccggggaucgcuacgugguggcugacuguggaggcggcacugucgaucucacaguucaccaacuugagcagccacaugggacucugaaagaauuguacaaggcgucgggagguccuuauggcgcaguggggguagaccuagccuucgagcagcugcucugcagaauauucggagaagacuuuaucgcuaccuucaagaggcagcggcccgccgcauggguggaucugacaauugccuuugaggcucgcaaaagaaccgccggcccacacagggcgggugcacuuaacaucucucugcccuucuccuuuauugacuucuaccguaagcaacgggggcacaaugucgaaacggcuuugcgaagaucaagugugaacuuuguuaaauggagcucccagggcaugcucaggaugucuugugaggccaugaaugagcuguuccagccuacugugagcggaaucauacagcauauugaagcauuacuggcccgcccagagguccaaggcgugaagcuacucuuucugguagggggauucgcugaaucagccguucuucagcacgcagugcaggcugccuugggugcgcggggccugagagucguggucccgcaugauguggggcucacaauccugaaaggagccguucuuuuuggccaggcucccggugugguaaggguccgccgaaguccucugaccuauggggugggcguuuugaaccgguucgugccaggacgucaucccccugagaagcuccuggucagagacggcaggcgcuggugcacugauguguuugagcgguucguagcagccgaacaauccguggcuuuaggggaggaaguuagaaggagcuacuguccagcccgacccggacagcgccggguccugauuaaucuauauugcugugcagcggaggacgccagauucaucacagauccgggugugaggaaaugcggcgcucucucucuggaacuugagccugccgacugugggcaggauaccgcaggagcuccacccggccgucgcgagauccgggccgcaaugcaguuuggugacacggaaauuaaggugaccgccgucgauguuucaacaaacagaagugugagggcuagcauagacuucuuguccaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6562 - RNA, 1692 nt, Artificial Sequence
  mRNA product Design5 comprising derived and/or modified sequence from Homo sapiens__NP_008879.3__HsHSPA13 (opt3)
gggagagucccgcagucggcguccagcggcucugcuuguucgugugugugucguugcaggccuuauucaagcuuaccauggcccgggagaugaccauccugggcagcgcugugcucacacuucuguuggcaggguacuuagcccagcaauaucugccccuaccuacuccaaaggucauuggaauagaccucgguacgaccuacugcuccguuggcguguucuuuccggggacaggaaaaguaaaggugauccccgaugaaaacggccacauuucuaucccuucaauggucaguuucacugacaaugauguguauguugguuacgagagcguggaacuggcggacuccaacccacagaauaccauuuaugaugcuaaaagguuuaucgggaagauauucacagccgaggaacuugaggcagagaucggacgguaccccuuuaaaguccugaacaagaauggcaugguggaguucucuguaaccucgaacgaaacuauuacaguuucaccugaauaugugggcagccgcuugcuccugaagcugaaagagauggccgaggcuuaccucgggaugccagucgcaaaugccgugaucagugugcccgcugaauuugacuuaaagcagcgaaacuccaccauugaggccgcgaaucuggcaggacuuaaaaucuugcgugucauaaacgaaccuacggccgcugccauggcauacggucugcauaaggcugauguuuuccacgugcuaguaauugaccucggcgggggaacucuggaugugucucuucugaauaaacagggcgguauguuuuugaccagagccaugagcgggaacaauaagcucggaggccaagacuucaaccagaggcuguuacaguaucuguacaagcagaucuaucaaacauacggcuuugucccaucccggaaagaggaaauucaucgccucagacaggcgguggagaugguuaaguugaaucugacuuugcaccagucagcccagcuaagugugcugcucaccgucgaggaacaagauaggaaagagccgcauagcucugacacagaacugcccaaggauaaacuuuccucagcagacgaccaccgggugaacagcggguucggacgcggucugagugauaagaaaucuggcgagucccagguauuguuugaaaccgagaucagccgaaaacucuucgacacgcugaacgaggauuuauuccagaagauccugguuccuauucaacaggugcuaaaggaagggcaccucgagaagacugaaauagacgaggucgugcuggucggaggcucgacaagaaucccaaggauuagacaggugauccaggaauuuuucgguaaagaucccaauaccucuguugacccugaucuugcugugguaacuggggucgccauacaagcuggcauugacggaggcuccuggccacuucaggugucagcccuggagauccccaacaagcaucuccagaaaacaaauuuuaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6563 - RNA, 1806 nt, Artificial Sequence
  mRNA product Design5 comprising derived and/or modified sequence from Homo sapiens__NP_057383.2__HsHSPA14 (opt3)
gggagagucccgcagucggcguccagcggcucugcuuguucgugugugugucguugcaggccuuauucaagcuuaccauggccgcuaucggcgugcaccuggggugcaccagcgcaugugucgccguuuacaaggacgguagagcgggagugguagcuaacgaugccggcgacagggugacacccgcagucguggccuauuccgagaaugaagagauuguugggcucgcugcaaaacagucucggauacgcaacaucucaaauacugugaugaaggucaaacaaauucuuggacgaaguagcuccgauccucaggcccagaaguacaucgcugaaucuaaaugccuggugauugagaagaacggcaaguugcguuaugaaaucgacacgggugaggagaccaaauucguaaauccagaagauguugccagauuaauauuuucgaagaugaaagagacagcgcauucagugcuggggagcgacgcaaacgaugucgugaucacugugccguucgacuuuggagaaaagcagaaaaaugcccuaggcgaggcugccagggcagcuggcuucaacguccuccggcugauucacgagcccagugccgcgcuucuggccuacgggaucggacaagauuccccuaccgguaagucuaauauuuugguuuuuaagcucggcgggacaagccugucccugucagugauggaaguaaacaguggaaucuaucgcgugcucagcaccaauacugacgauaacauaggcggugcacauuucacagagaccuuagcucaguaccuggccucugaauuucagagauccuucaaacacgacgucagggggaaugcucgggccaugaugaagcugacgaacucagcagagguggccaaacauagcuugaguacucugggaucugcuaauuguuuucuagauucccucuaugaaggccaggacuucgacugcaacguuagccgcgcgcgauuugagcugcuuuguucgccacuguucaacaagugcauugaggcaaucagaggcuugcucgaucaaaauggguuuaccgccgacgauauuaacaaagugguccuguguggagguucuuccaggauccccaaguuacagcagcugaucaaagaccucuucccugcuguggaacuucuuaauucaauuccacccgaugagguaauaccuaucggcgccgcaauugaagccgggaucuugauaggaaaggagaaccuacugguugaagacagucucaugauugagugcagcgcucgggauauccuggugaagggcgucgacgaguccggugccucucguuucacagugcuuuuuccaagcgggacuccgcugcccgcacgcagacagcacaccuugcaagcgccuggcucaaucaguuccgucugucucgaacuguacgagagcgauggcaaaaauucugcuaaggaagagacaaaauucgcccaggugguuuuacaggaccuggauaagaaagaaaacggacuaagggacauucucgcagugcugaccaugaagcgggacgggucacuucacguaacgugcacugaucaagagacaggaaagugugaggccaucaguauugaaauagcuagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6564 - RNA, 2853 nt, Artificial Sequence
  mRNA product Design5 comprising derived and/or modified sequence from Homo sapiens__NP_006635.2 __HsHSPH1 (opt3)
gggagagucccgcagucggcguccagcggcucugcuuguucgugugugugucguugcaggccuuauucaagcuuaccaugagcguggucggccuggacguugggucccagucuugcuacaucgccguggcuagagcaggagguauugagaccauagccaacgaguucucagauagguguacacccaguguaaucagcuuuggcuccaagaaucggacuauugggguggcggcuaaaaaccaacagaucacgcacgccaauaacaccgucucuaauuucaagcgcuuucauggacgagcauucaacgacccuuuuauucagaaagagaaggaaaaucucucguaugaucuugugccacugaaaaacggcgguguugggaucaaggugauguacaugggagaggaacacuuguucucagucgagcagauaacagccauguuacugacuaagcuaaaagagaccgcugaaaauagccucaagaaaccggugacagacugcguaaucaguguucccuccuuuuucaccgaugcagagcguagaucugugcuggacgccgcucaaauugucggccuuaacugucugagguugaugaaugauaugacugccguggcgcucaacuauggcaucuacaagcaggaccugccuagccuggaugaaaaaccacggauuguggucuuuguugacauggggcauuccgcauuccaggugucagccugcgcuuuuaauaagggaaagcucaaaguauuagguacagccuucgaucccuuucugggcgggaagaacuucgacgagaaacuuguggagcacuucugugcagaauuuaagaccaaauauaaguuggaugcuaaaaguaagauccgcgcccugcuaagacucuaccaggagugcgaaaagcugaaaaagcugaugagcucuaauuccacggaccuuccuuugaacauagaguguuucaugaacgacaaagaugucucaggaaagaugaauaggagccaauuugaagaacucugcgcggagcuguuacagaaaauugaagugccacuguauagucuccuugagcagacucaucugaagguugaagacgugucugccgucgagaucgugggcggugcaacccggauucccgcuguaaaggaacgcaucgccaaauucuuugggaaggauaucuccacaacuuugaacgcugacgaggccguugcacgaggaugugcccuacagugcgcuauucugagcccugcguucaaagugagagaguuuucggucaccgaugcagugccauucccgauaucucucaucuggaaucacgacuccgaagauacagagggcguccacgaaguguuuucaaggaaccaugccgcucccuucaguaagguucugaccuuucuucggcguggcccuuucgagcuggaagccuuuuacagcgacccacaaggggugcccuacccugaggcaaaaauuggacgcuucguaguccagaauguguccgcccagaaggauggugagaagucuagaguuaaagugaaggucagggugaacacgcacggcaucuucacuauaagcacagcuucaaugguagaaaaagugccaaccgaggaaaaugagaugaguuccgaggccgacauggaauguuugaaccaacggcccccggagaauccugauacugacaagaacguucagcaggacaauagcgaagcagggacacagccccaaguccagaccgaugcgcagcagacgucucaaucaccaccuagucccgagcucaccagcgaagagaacaaaauuccagacgcugauaaggccaaugagaagaaaguggaccagcccccugaagcaaagaaaccaaagaucaaaguggucaacguugagcugccgaucgaagccaauuuaguguggcagcugggaaaggaucuacucaacauguauauugagacagaaggcaaaaugaucaugcaggacaagcuggagaaggagcgaaacgaugcuaaaaaugccguggaagaguacguauaugaauuucgcgacaaacuuugcggucccuacgagaaauucauuugcgaacaagaucaucagaacuuuuugagacugcucacugagaccgaggacuggcuguaugaagagggggaagaucaggcaaagcaggcuuacgucgacaaacuugaggagcugaugaagauaggcacaccugugaagguuagguuccaagaagccgaggaacggccaaaaauguuugaggaauugggacagcgccuccagcacuaugcgaagaucgccgcugauuucagaaauaaagacgagaaguacaaccacauugacgaguccgaaaugaaaaagguggagaagucugucaaugaagugauggaguggaugaacaauguuaugaacgcacaagccaaaaagucgcuggaucaggaccccgugguaagggcucaggaaaucaaaacuaagaucaaagaguuaaauaacaccugugagccugucgugacacagccaaagcccaagauugaaagcccgaaacuggagcguaccccuaauggcccaaacauagauaagaaagaagaggaccuagaagauaagaauaacuuuggggccgagcccccucaucaaaauggagagugcuaccccaacgaaaagaacuccgugaauauggaccucgauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6565 - RNA, 3276 nt, Artificial Sequence
  mRNA product Design5 comprising derived and/or modified sequence from Homo sapiens__NP_006380.1 __HsHYOU1 (opt3)
gggagagucccgcagucggcguccagcggcucugcuuguucgugugugugucguugcaggccuuauucaagcuuaccauggccgacaaggugagaaggcagcggccccgccgacgugucugcugggcucugguugcagugcuccuugccgaucuguuggcguuaagcgacacccuggcuguaauguccguggaucuaggcucugagucaaugaaagucgccaucgugaagccugggguuccaauggaaauugugcucaacaaagagaguagaaggaagacaccggucauagugacucugaaagaaaaugagcgguucuuuggagacagcgcagccuccauggcuaucaagaaccccaaggcaacgcuucgcuacuuccaacaccuguuggguaaacaggccgauaauccucauguagcucucuaucaggccagauuuccagaacacgagcugaccuucgacccccagaggcaaacaguucauuuucagauuucuucgcagcugcaguucucaccugaggaagugcucggcauggucuuaaacuacagccggagucuggcggaggauuuugcagaacaaccaaucaaggacgccgugauuacugugcccgucuucuuuaaucaggcugagcgccgagccguucuucaggcagcuagaauggccggguugaaagugcugcagcuaaucaacgauaauaccgcgacagcccucuccuauggaguauucaggcggaaggacauaaacaccacugcacaaaauaucauguuuuacgauaugggcucugguagcacaguguguaccauugucacguaucagauggugaaaacuaaggaggcugggaugcagccucaacugcagauccguggaguuggcuucgaccgcacccuuggcgggcuggaaauggaguugagacucagggaacggcuggccggauuauuuaacgagcagcgaaagggucagcgcgcuaaagaugugagagaaaauccaagggccauggcaaagcugcuccgggaggccaaccgccuuaaaacaguccuguccgcuaaugcggaccacauggcacaaauugagggcuugauggacgauguggacuucaaggccaaaguaacuagaguugaguucgaggaacuaugcgcugaucuguuugagagggugccggggcccguccagcaggcccuccagucagcagaaaugagucuggacgagaucgagcaagugauacuugucggaggcgccacccgugugccucggguucaggaagugcuguugaaggcuguagguaaagaggaacucgggaagaacauuaaugccgaugaggcagcggcuaugggagccgucuaccaggcagccgcucugagcaaggccuucaaagugaagccauuuguugugcgagacgcagucguguaucccaucuuaguagaguucacaagagagguggaggaagaaccuggcauucauucucugaaacacaacaagaggguucuauuuucccgcaugggcccauacccccagcggaaagucaucaccuucaacagauacucacacgauuuuaauuuccauaucaacuauggggaccucggauuucuggguccggaagaucuuaggguguucggcagccaaaauuugacgacugugaagcugaagggggucggagacaguuuuaaaaaguacccugauuaugagucuaaaggcauuaaggcucacuucaaccucgacgaguccgguguucugagccuugaccgcguggaaucgguguuugagacacugguagaagauucugccgaggaagaguccaccuugacuaaacucgggaauacaauaucaagucuguucggcggaggcaccacgcccgacgcgaaggagaacgggaccgauacaguccaggaagaggaagagagcccagccgaaggauccaaggacgagccuggugaacagguggaauuaaaagaggaagcugaggcacccguugaagauggcucucagccacccccuccagagccgaagggggacgccacucccgagggagaaaaagcuaccgagaaggaaaauggcgauaaaagcgaggcccaaaagccuucagagaaggcagaagcggguccagaggggguggcccccgcuccugaaggcgagaaaaagcagaaaccagcccgaaagcggcguauggucgaagagaucggaguggagcugguugugcuagaccuccccgaucugccggaagacaaacuugcacagaguguacaaaaguugcaggaucugacacucagagaccuggagaaacaggaaagggagaaggcugccaacuccuuagaagcauucauuuuugagacucaggauaagcuguaccaaccugaguaucaggaagucagcaccgaggaacagcgcgaggaaaucucuggcaaacuuucagccgcuaguacaugguuggaggacgagggggugggagcgaccacugugaugcucaaggaaaaacuggccgagcuacggaagcugugucagggucucuucuuuagagucgaagagaggaaaaaguggccagagcgacugagcgcacuugacaauuugcugaaccauuccucuauguucuuaaagggcgcucgccucauacccgaaauggaucaaauuuuuacggagguugaaaugacaacccuggagaaagugaucaaugaaacuugggccuggaagaacgccacccuugcugagcaggcaaaacugccugccacagagaagcccguauugcucucgaaagacaucgaagcgaagaugauggcucuggaucgggaggugcaguaccuacugaauaaggccaaauucaccaagccaagaccuaggcccaaagacaagaacgggacucgugcagaaccaccgcucaaugccagcgcuuccgaucagggagagaaagucauuccucccgcaggccaaacagaagacgccgagccaaucucagagcccgaaaagguggagacggguagugaaccuggggauaccgagccacuggaacuuggcggacccggcgcggagccugagcagaaggaacagucuacugggcaaaaacgcccguugaagaacgacgagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6566 - RNA, 2475 nt, Artificial Sequence
  mRNA product Design5 comprising derived and/or modified sequence from Homo sapiens__NP_005339.3 __HsHSP90AA1 (opt3)
gggagagucccgcagucggcguccagcggcucugcuuguucgugugugugucguugcaggccuuauucaagcuuaccaugcccgaggaaacccagacacaagaccagccuauggaggaagaggaaguggagacuuucgccuuucaggcugagaucgcacagcugaugagccucauuauaaacacguucuacuccaauaaggaaaucuuucuuagagagcugauuucuaacucaagugaugccuuggacaaaaucagguaugagagcuuaaccgauccauccaagcuggacucuggcaaagagcuacacauuaaucucaucccgaacaagcaagaucggacacugacuauagucgacaccgggaucggaaugacaaaagcggaucuuauuaauaaccuggguaccaucgcuaagucgggcacuaaggccuucauggaggcauugcaggccggggcugacauuucaaugaucggacaguuuggcguugguuucuacagcgcauaucucguggccgaaaaaguaacagugauaaccaagcauaaugaugacgagcaguacgcuugggaaaguuccgccgggggaucuuuuacgguccgcacugauaccggcgagcccaugggccgagggacaaaagugauucugcaccugaaggaagaccaaacugaguaucucgaggaacguagaaucaaagagauuguuaagaagcauagccaguucaucggauacccuaucaccuuauuuguggaaaaagagagggauaaggaagucuccgacgacgaggcggaggaaaaagaggauaaggaagaggaaaaagagaaggaggaaaaagagucagaagacaagccagagauugaggauguggguagugacgaagaggaagagaagaaagauggcgacaagaaaaagaaaaagaagauaaaagaaaaguauaucgaucaggaggagcugaacaaaacaaagcccauuuggacccggaauccugacgauaucacgaacgaagaguacggggaguucuacaaaagccuuacuaaugacugggaagaucacuuggcaguaaagcauuuuucuguugaaggacagcuggaguuccgcgcccuacucuuugugccaagaagggcucccuucgaccuguucgagaaccggaagaaaaagaauaacauaaaacuuuauguccgccgaguguuuauuauggacaauugcgaagaacugaucccugaauacuugaacuucaucagaggcguggucgauuccgaggaccucccacugaacauuucaagggaaauguuacaacagagcaagauccugaaaguuauucggaagaaucucgugaagaaaugucuugagcuguuuacagaguuggccgaagauaaggagaacuauaaaaaguucuacgaacaguuuaguaaaaauauaaagcuagguauccacgaggacucucaaaaccguaaaaagcuguccgagcuccugcgcuauuacaccagcgcaucgggggaugaaaugguaucucuuaaggacuauugcacuagaaugaaagagaaucagaagcacauuuacuacaucacaggagaaaccaaagaucagguggcuaacuccgccuucgucgagaggcugcggaagcauggcuuggaagugaucuauaugauugagccgauagacgaguacuguguucagcaacucaaagaauuugagggcaagacgcuggugucagucaccaaggaaggguuagagcugcccgaagaugaggaggagaaaaagaaacaggaagaaaagaaaacaaaguucgagaaucuaugcaagaucaugaaagacauucucgaaaagaaaguggagaagguaguugugaguaaccgacuggucacuagcccuuguugcaucgugaccuccacauauggauggacugcgaauauggagcgcauuaugaaagcccaggcacuuagagauaacucuaccauggguuacauggcugccaagaagcacuuggaaaucaauccagaccauagcauaaucgagacacugaggcagaaagcugaagccgauaagaacgacaaaucagucaaggaccucgugauucugcuuuaugagaccgcacuguugaguuccggcuuuagccucgaggauccccaaacucacgccaaucggaucuaccgcaugauuaaacugggguuaggaaucgacgaagaugacccuacggcugaugacacaucugcggcaguuaccgaggaaaugccaccccuggagggcgaugacgauacuucaagaauggaagagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6567 - RNA, 615 nt, Artificial Sequence
  mRNA product Design5 comprising derived and/or modified sequence from Homo sapiens__NG_005218__HsHSP90AA3P (opt3)
gggagagucccgcagucggcguccagcggcucugcuuguucgugugugugucguugcaggccuuauucaagcuuaccauggacagcuccaagcuggauucuggcaaagggcuccacaucaaccuugugcccaauaagcagaaccaaacccugacaauugucgacacuagaauaggaaugacgaaaaccgauuugaucaauaacuuagguacaguuacuaagucaggcaccaaagccuucauggaggcucugcaggcagacgccgauauuaguaugaucgggcauuuuggagugggcuucuacagcgcguaucuaguagcuaagaaggugacagucauuuccaaacacaauaacgacgaacaguacaccugggagucuucggccggugggucauuuacugugaggacagaugaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6568 - RNA, 2451 nt, Artificial Sequence
  mRNA product Design5 comprising derived and/or modified sequence from Homo sapiens__NP_031381.2__HsHSP90AB1 (opt3)
gggagagucccgcagucggcguccagcggcucugcuuguucgugugugugucguugcaggccuuauucaagcuuaccaugcccgaggaagugcaccauggcgaggaagaggucgaaaccuucgccuuucaggcugagaucgcacaacugaugagccucauuauaaacacauucuacuccaauaaggagaucuuucuuagagaacugauuucuaacgccucagacgcguuggauaaaaucagguaugagaguuuaacugacccuagcaagcuggauuccgggaaagaacuaaagauugacaucauaccaaauccgcaggagcggacgcucacccugguugauacaggaaucgguaugacuaaagcugaccuuauuaacaaucugggcaccaucgccaagucugggacaaaggcauucauggaggccuugcaggcuggagcagauauuucgaugaucggccaguuuggugugggguucuacucagccuaucucguagcugaaaaaguggucgugauaaccaagcacaacgacgaugagcaauacgccugggaaagcagugcgggaggcuccuuuacuguucgcgcagaccauggcgagcccauugggcgaggaacaaaagugauccugcaccugaaggaagaucagaccgaguaucucgaggaacguagagucaaagaggugguaaagaagcauucucaguucauugguuacccuaucacguuauaucuggaaaaagagagggaaaaggagaucagcgacgaugaggccgaagaggaaaaaggcgagaaggaagaggaggacaaagacgaugaagagaagccaaaaauugaagacguuggguccgaugaggaggacgauucaggaaaggacaagaaaaagaaaacuaagaaaauaaaggaaaaguacaucgaucaggaggaacuuaauaaaaccaagcccauuuggacacggaacccugacgauaucacucaagaggaauacggcgaguuuuauaaaaguuugaccaaugacugggaggaucaccuggcugugaagcacuucagcgucgaaggucagcuagaguuucgcgcccuccuguucauaccaagaagggcacccuuugaccuuuucgaaaacaaaaagaagaaaaauaacauuaagcuguacgugcggcgcguguucaucauggacucuugcgaugaguugaucccugaauaucucaauuuuauucgaggggucguugacuccgaggaucugccauuaaacaucucaagagagaugcugcagcagagcaaaauucucaaggugauaaggaaaaauaucguaaagaagugucuugaacuguucagugaguuggcugaagacaaagagaacuacaagaaauuuuaugaagccuucucuaagaaccuaaaacugggcauucaugaggauuccacaaaucggcgucgccucagcgagcugcuuagauaccacaccucgcaaucuggagacgaaaugacgucccugucagaguaugugaguaggaugaaggaaacucagaaaagcaucuacuacaucacaggcgaguccaaggagcaggucgcgaacucugccuuuguggaacggguucgaaagcgcggguucgagguggucuauaugaccgaaccgauugaugaguacugcgugcaacaguugaaagaauuugacggaaagagccucguaucaguuacuaaagagggucuggaguuacccgaagaugaggaagagaagaaaaagauggaagagaguaaggcaaaauucgagaaucuguguaagcuaaugaaagaaauacucgacaagaaaguggagaaggucacaaucuccaacagacuggugagcucuccuugcuguauugucaccucaacguauggcuggaccgcuaauauggaaaggaucaugaaggcccaggcccuucgggauaacaguacaaugggguacaugauggcuaaaaagcauuuggagauuaauccagaccaccccaucguggaaacucugcgccagaaagcagaggccgauaagaacgacaaagcuguuaaggaccucgugguacugcuuuuugagaccgcgcuguugagcuccggauucucucucgaagauccucaaacacacucgaauagaauauauaggaugaucaagcugggcuuagguauugacgaggaugaagucgcagccgaggagccaaacgcugccgugcccgacgaaaucccgccucuggagggggaugaagacgcaagccguauggaggaaguugauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6569 - RNA, 2688 nt, Artificial Sequence
  mRNA product Design5 comprising derived and/or modified sequence from Homo sapiens__NP_003290.1__HsHSP90B1 (opt3)
gggagagucccgcagucggcguccagcggcucugcuuguucgugugugugucguugcaggccuuauucaagcuuaccaugagagcccugugggugcucggccuuugcuguguccuguugaccuucgggagcguuagggcugacgaugagguggacguagauggaacaguggaagaggacuuagguaagucccgggaaggcucucgcacugaugacgaggucgugcagcgagaagaggaggcaauccaacuggaugggcuaaacgccucacagauucgugaacucagagagaaaagugaaaaguuugcguuccaggcugagguuaauaggaugaugaaacugauaaucaacagccuuuacaagaauaaagagauuuuucugcgggaauugaucuccaacgccucugacgcacucgauaagauucgccugaucucgcugacggacgagaaugcccucucaggaaacgaagaguuaaccgugaagauaaaaugcgauaaggagaaaaaucugcuucacgucacagacacuggcguggguaugaccagagaggaguugguaaagaaccuggggacaaucgcuaaaagcggaaccagugaguuccuaaauaagaugacugaagcacaggaagauggccaauccacaucugagcucauuggccaguuugggguuggauucuauagcgccuuucugguggcugacaaggucaucgugaccuccaaacauaacaaugacacgcagcacauuugggaaucagauaguaacgaguucagcgugaucgccgaccccagggguaauacucuuggccgggggaccacaauaacucuggucuugaaggaggaagcgucugauuaccucgagcuggacaccauuaaaaacuuaguuaagaaauauucccaguuuaucaauuucccuauuuacguguggucaagcaagacagaaaccguagaggaaccaauggaggaggaagaggcagccaaagaagagaaggaggaaagugaugacgaggcugccguggaagaggaagaggaggaaaagaaaccgaagacgaaaaaggucgagaaaacugugugggauugggaacugaugaacgacaucaagcccaucuggcaacgcccuucuaaggagguugaagaggaugaguauaaagcauuuuacaaguccuucagcaaagaaucggacgauccaauggcuuauauucauuuuacagccgagggagaagugaccuucaagucuauacucuucguccccacuuccgcgccucgaggccuuuuugacgaguacgguaguaaaaagucagacuacaucaagcuguaugugagaaggguauucauuacagaugacuuucacgauaugaugccaaaauacuugaacuucguuaaggggguggucgacagcgaugaccuaccccugaaugugucccgggaaacccuccagcagcauaaacugcuuaaggucauccguaaaaagcuggugcgcaagacguuggauaugauuaaaaagauagccgacgauaaauauaacgacaccuuuuggaaggaguucggaacaaauaucaaacucggcguuaucgaggaucacucuaacagaacuaggcuggcaaaguuacugcgguuucagagcucacaccauccuaccgacauuacaagucuagaucaauacguggaacgaaugaaagagaagcaggacaagaucuauuucauggcuggcuccagccgcaaagaagccgagucuucaccauuuguagagagacuccugaagaaaggguacgaagucauuuaucuuacugagccgguggacgaauacuguauacaggcuuugcccgaguucgauggaaagagguuucaaaauguugccaaagaaggugugaaguucgacgagagugagaagaccaaagaaagccgggaggcagucgaaaaggaguuugaaccucugcucaacuggaugaaagauaaggcccugaaagacaagaucgagaaggcugugguaucccagcgccuuacagagucuccaugcgcgcugguggcaucgcaguacggcuggagcgggaauauggaaagaauuaugaaagcccaggcuuaucaaaccggaaaggauaucuccacuaacuacuaugccucacagaaaaagacguucgagaucaaucccaggcacccuuugauucgugacaugcuccggcgaauaaaagaagaugaggacgauaagacaguucuggacuuagcagucgugcuguucgaaaccgccacucuaagaaguggcuaccuccugccagauaccaaggcuuauggugacaggaucgagcgcaugcuucgguugucucugaacauugaucccgacgccaaaguggaggaagaaccggaagaggagccugaagagacagcagaagacaccacugaggauacagaacaggacgaggaugaggaaauggacgucgggacggaugaggaagaggaaaccgcgaaggagagcacugcugagaaagacgaacucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6570 - RNA, 2391 nt, Artificial Sequence
  mRNA product Design5 comprising derived and/or modified sequence from Homo sapiens__NP_057376.2__HsTRAP1 (opt3)
gggagagucccgcagucggcguccagcggcucugcuuguucgugugugugucguugcaggccuuauucaagcuuaccauggccagagagcugagggcucuccuucuguggggccggcgcuugcgacccuuacugcgugcuccugcccuagcggcugugccagggggaaagccgauccucugccccagaaggaccacagcccagcuggguccucggcgcaacccagcauggagccuucaagccggcagacuguucuccacucagacggcugaagacaaagaggaacccuugcacucuauuauaucaaguaccgagagcguccagggguccacaucuaagcaugaauuucaggcagagacuaaaaagcuccuggauaucguugccaggucgcuguacucagagaaagaaguguucauucgggagcucaucagcaaugcuagugacgccuuagaaaagcugcgccacaagcuaguauccgauggacaagcguugccugagauggagauucaucugcagaccaacgcagaaaaaggcacaaucaccauacaggacacugguaucgggaugacacaggaggaacuugugucuaaucucggaaccauugcccgaagcggcuccaaggcuuuucuggaugcccuucaaaaccaggcagaggcuucaaguaaaaucauuggccaguucggggucggauuuuauagcgccuucaugguggcggacagaguugaaguguacucuagguccgccgcaccagguucacugggcuaucagugguugagcgaugggaguggagucuuugagaucgcugaggccucuggcgugcggacggguacuaagauaauuauccaccucaaauccgacuguaaggaauuuagcucggaggcucguguacgcgauguugugaccaaguacucuaauuuugucuccuucccccuguauuuaaacgggagaaggaugaauacacugcaagccauuuggaugauggacccuaaagaugugcgggaauggcagcaugaggaauuuuaccgauauguggcacaggcccacgacaagccacgcuacacucuccacuacaaaaccgaugcuccgcuuaacaucagaucaaucuucuauguccccgacaugaagccuaguauguuugacguuagcagggagcugggauccucuguggcguuguacagccggaaaguacuaauucaaacaaaggcaaccgauauacugccaaaauggcuccgcuucaucagaggcguggucgacucagaggauauuccccugaaucuuaguagggaacuguugcaggaguccgcccucauccguaagcugcgggacguguuacagcagcgacugauaaaguucuuuauugaucaaagcaaaaaggacgcugaaaaauaugccaaguucuuugaggauuacggccuauucaugagagaagggaucguuacggcaacugagcaggaggugaaagaagacaucgccaagcuccugagguaugagucuucagcacuuccuaguggacaguugacaagccuguccgaauacgccucucgcaugcgggcagguaccagaaacauuuauuaccucugcgcgccaaauaggcaucuggcugagcacucgcccuacuaugaggccaugaagaaaaaggauacugaaguccuuuucuguuucgagcaguuugacgaacugacauugcuccaucugcgcgaguucgauaaaaagaaauuaaucagcguggaaaccgacauuguaguugaccacuacaaggaggagaaguuugaagaucgauccccggcagccgagugccugucagaaaaagagacggaagaacuaauggcuuggaugcggaacgugcucggcagucgugucaccaaugugaaggucacacugagacuugacacucacccugccauggugaccguuuuggagaugggggcagcuaggcauuuccugcgcaugcaacagcucgccaaaacacaggaggagcgggcgcagcuguuacaacccacucuggaaauaaacccaagacacgcccuuaucaagaaauugaaucagcucagggcuucugagccuggacuggcacagcuacugguggaucagauuuaugaaaacgccaugaucgcugccggccucguagacgauccccgagcaauggucggucgccugaacgagcuuuuggugaaggcgcuggagcggcauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6571 - RNA, 738 nt, Artificial Sequence
  mRNA product Design5 comprising derived and/or modified sequence from Homo sapiens__NP_000609.1__HsIGF1 (opt3)
gggagagucccgcagucggcguccagcggcucugcuuguucgugugugugucguugcaggccuuauucaagcuuaccaugggcaagaucagcucccugcccacccaacucuucaaaugcuguuuuugcgacuuccuuaaggugaaaaugcacacaaugucuucaagucaucuguuuuacuuggccuuaugucugcuaacuuucacgagcuccgcuaccgcagggccugagacacucugcggagccgaacuggucgaugcgcuucaguuuguuuguggugacagaggcuucuauuuuaacaagccaacuggguacggaucuucgucaaggcgggcuccgcagaccggcauuguggaugagugcuguuuccgcagcugcgaccugcgacguuuggaaauguauugugcaccccucaaaccugccaagagugccagauccguaagggcucagcggcacacagauaugccaaagacccagaaagaggugcaucugaagaaugcaucucgcgguagcgccgggaacaaaaauuacagaaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6572 - RNA, 819 nt, Artificial Sequence
  mRNA product Design5 comprising derived and/or modified sequence from Homo sapiens__NP_000603.1__HsIGF2 (opt3)
gggagagucccgcagucggcguccagcggcucugcuuguucgugugugugucguugcaggccuuauucaagcuuaccaugggcauccccaugggaaagagcaugcuggugcuccuuaccuuccuggccuuugcuuccugcuguauugcagccuacagaccuucugagacauugugcgggggugaauuagucgacacucugcaguucguuuguggcgauaggggguuuuauuucucacggccagcgagucgcgugagccgacguuccagaggaauaguagaggaaugcuguuuuaggucuugcgaccuagcucuccuggagacguacugugccaccccggcaaaaucggaacgggaugugucaacacccccuacuguccuuccagacaacuucccccgcuauccugugggcaaguuuuuccaauacgauaccuggaaacagagcacacagagacugaggcgggguuugccagcccuccugcgcgcucgaagagggcacguucuggcaaaggagcucgaggccuuuagggaagcuaaacggcaucgucccuuaaucgcccugccuacccaggacccagcgcacggaggcgcaccgcccgagauggccaguaaucgcaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6573 - RNA, 915 nt, Artificial Sequence
  mRNA product Design5 comprising derived and/or modified sequence from Homo sapiens__NP_000591.1__HsIL6 (opt3)
gggagagucccgcagucggcguccagcggcucugcuuguucgugugugugucguugcaggccuuauucaagcuuaccaugaacagcuucuccaccucugccuuuggccccguggcuuucucacuggggcuccuucuggucuugccugcagccuuuccagcgccgguucccccuggagaggacaguaaggauguggcugccccacacagacagcccuuaacaagcuccgaaaggaucgacaaacaaauucgguacauacuggaugguaucucugcacuacgcaaggagacuugcaauaaaucgaacaugugugaaucaagcaaggaggcccucgcugaaaauaaccugaaucuuccuaaaauggcagagaaggacggcugcuuccagaguggguuuaacgaggaaacgugucugguaaagauuaucaccggauugcucgaguucgaaguguaucuggaguaccugcagaaucgauuugaguccucugaagaacaggcccgugcuguccaaaugagcacaaaagugcucauucaguucuuacagaagaaagccaagaaccuggaugcgaucacuaccccagaccccacaaccaaugcaucccuuuugacuaaacugcaggcccaaaaccaguggcuacaggauaugacaacccaucucauacugagaucauuuaaggaguuccuucagaguagccugagggcuuugcggcaaaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6574 - RNA, 1557 nt, Artificial Sequence
  mRNA product Design5 comprising derived and/or modified sequence from Homo sapiens__NP_002183.1__HsINHBA (opt3)
gggagagucccgcagucggcguccagcggcucugcuuguucgugugugugucguugcaggccuuauucaagcuuaccaugccccugcucuggcuuagaggcuuccuguuggccagcugcuggaucauugugagguccucuccuaccccagggucagagggacacagugcugcaccggacugucccagcugcgccuuagcggcucugccuaaggaugucccaaacucccagcccgaaaugguugaggccgugaaaaagcauauacuaaauaugcuccaccugaaaaagcggccugacguaacacaaccagugcccaaagcagcccuucugaacgcuauccgcaaguugcaugucgguaaggugggcgaaaauggguacguugagauugaagaugacaucggacgacgugcagagaugaacgagcucauggaacagacuucugagauuaucacguuugccgaaucgggcaccgcuagaaaaacacugcacuucgagauaucaaaggaggguagcgaucugaguguggucgaaagggccgagguguggcucuuuuuaaaaguaccuaaggcgaaucggacucgcaccaaaguuacaaucagacuguuccagcagcaaaagcauccacaggggucccuugacaccggagaagaggcagaagaggugggcuugaagggcgagaggucugaacugcuacucagcgagaaagucguggaugcccggaaguccacuuggcacguguuuccggucucaaguagcauucagcgccugcuugaccaggggaaaucuucccuggauguucgaaucgcuugugaacaaugccaggagucaggagccagcuuggugcuccuggguaagaaaaagaaaaaggaagaggagggcgaagggaagaaaaagggaggcggugaagggggagcaggcgcugacgaggagaaagaacagagucacagacccuucuuaaugcugcaggccaggcaaucugaggaucauccucaccggcgucgcagaaggggccucgagugugacgggaagguaaacauuugcuguaaaaagcaguuuuucguguccuuuaaggauaucggauggaaugacuggauaauugcgccaagcgguuaucaugccaacuacugcgaaggcgagugucccucgcacaucgcagggacaucuggauccucacuuaguuuccacagcaccgucauuaaucauuaucggaugcgaggccacuccccuuuugcuaaccugaaaucuugcugugugccaacgaaguugcgccccaugagcaugcuauacuaugacgauggucagaauaucaucaaaaaggacauucaaaacaugauaguugaagagugcgggugcucaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6575 - RNA, 1500 nt, Artificial Sequence
  mRNA product Design5 comprising derived and/or modified sequence from Homo sapiens__NP_002184.2__HsINHBB (opt3)
gggagagucccgcagucggcguccagcggcucugcuuguucgugugugugucguugcaggccuuauucaagcuuaccauggacggccugcccgggagagcccucggagcugcaugccuucuguuguuagccgcggguuggcugggcccugaggcuugggggagcccaaccccgcccccuacaccagccgcacccccuccacccccuccaccgggaucccccggcgguucucaggauacuuguacgucaugcgggggauucaggcggccugaggaacuaggccgcguggacggcgauuuucucgaagccgucaagcgacacauccugagucgucuucaaaugagagggaggccaaacauuacccaugcuguucccaaagcagccauggugacagcucugcggaaguugcacgccggaaaaguacgcgaggacgguagaguggaaauaccucaucucgauggccacgcgagcccaggggcagacggacaggagagggucuccgagaucauuucuuucgccgaaacugauggccuggcuucgucacgggugcgccuguacuuuuucaucagcaaugaggguaaccagaaucucuuuguugugcaggccaguuuauggcuguaucuuaaguugcugcccuacguccuagaaaaagggucccgaagaaaggugaggguaaagguuuauuuccaagagcagggacauggcgaccgguggaacaugguggagaaacgugucgaucucaagcgcucuggcuggcacaccuuuccgcugacagaagcaauucaggcucuuuucgagagaggggaaaggcggcugaauuuggacgugcagugugauagcugccaagagcucgccguggucccuguuuuuguggaccccggagaagagucccaccgaccauucguagugguccaggcgcgccugggugauucaagacauaggauccggaaacgcggcuuagagugugacgggagaaccaaccugugcuguaggcagcaguuuuucauagacuuucgucucaucggauggaaugauuggauuaucgccccuacuggcuacuaugguaacuacugcgaagggaguugucccgcauaucuugcuggcgugccaggaagcgccucuuccuuccacacagcuguugugaaucaauaccggaugcgaggccugaaccccgggaccgucaauucaugcuguauuccuacgaaguugagcacuaugaguaugcuauacuucgacgaugaguauaacaucgugaaaagagacguaccaaauaugauaguugaagagugcggaugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6576 - RNA, 3735 nt, Artificial Sequence
  mRNA product Design5 comprising derived and/or modified sequence from Homo sapiens__NP_000623.2__HsITGAM (opt3)
gggagagucccgcagucggcguccagcggcucugcuuguucgugugugugucguugcaggccuuauucaagcuuaccauggcccugagagugcuccuucugaccgcuuugacauuaugccacggcuucaaccuggacacugagaaugcaaugacguuucaggaaaacgccaggggguucggacaaagcgucguucagcuacaggguucccgggugguagugggcgcgccccaggagaucgucgcugccaaucaacgcgggucucucuaccagugugauuauucaaccggaaguugcgaaccuauucgacugcaagugccaguugaggcagugaacaugagccuuggccuguccuuggccgcuacaacuucuccgccccagcuccuggcaugugguccuaccguccaucaaacaugcucggaaaauaccuacgugaaggggcuguguuuucucuucggaucaaacuuacgucagcagccacagaaauuucccgaggcccugagaggcugcccucaagaggacagcgauauagcuuuccuuaucgacggcaguggguccauuaucccacacgauuuuaggcggaugaaggaguucguaucuacuguuauggaacaguugaaaaagagcaaaacacuguuuucccuaaugcaguauucagaagaguuccgcauucauuuuaccuucaaggaguuucaaaauaaccccaauccuagaagucucgugaagccaaucacgcagcugcuuggaaggacucacaccgccacagguauacggaaagucgugcgcgaacuguucaacaucacuaauggcgcgcgaaagaacgcauucaaaauuuugguggucaucaccgacggggagaaguuuggagauccgcucggcuacgaagacguuauucccgaggccgauagagaaggugugaucagguauguaauaggggugggagacgcuuuccggagcgagaaaucucgucaggagcugaauacaauugccuccaagccuccacgcgaucaugucuuucaggugaacaauuucgaagcauuaaagaccauccaaaaccagcugagagagaaaauuuuugcuaucgaaggcacgcagacuggcucaagcaguucuuucgagcacgaaaugucccaggagggguuuagcgccgcgaucacaucgaacggaccccuccuuucuaccguugguuccuacgacugggccggcgggguguuccuguauacuucaaaggagaaaaguacauuuauuaauaugaccagggucgauagcgacaugaacgacgcauacuugggauacgcugccgcuauaauccuacggaaucgagugcaaucccugguacucggcgccccucgcuaucagcacauuggucugguugcaauguucagacagaacacggggaugugggaaucuaaugccaacgugaagggcacccagaucggagcuuacuuuggcgcgagccuuuguucagucgauguggacaguaauggguccacagaucuggucuugauaggagcaccacauuauuacgagcaaacuagggguggccaggugagcguuugcccccucccgcgggggcgcgccagauggcagugugacgcugugcuguauggagaacagggccaaccuugggguagguucggggccgcauuaaccguacugggcgaugucaacggagacaaacuaacagauguggccauuggcgcucccggggaggaagacaaucguggagccguuuaccucuuucacgguacuucuggcucagggaucaguccaagccauucccagcggaucgcaggaucuaagcugucgccucgacuucaguauuucggccagagcuuguccggugggcaggaucugaccauggacggccucguggaucugacagucggagcgcagggccacgugcuucuguugagaucacagcccguacucagggugaaagcuauuauggaguucaacccacgcgagguugcccggaaugucuuugaaugcaacgaccaaguggugaaggggaaggaggcaggagaagucagaguuugucugcacgugcagaaaaguaccagggaccgcuuacgagagggccagauccagucugugguaacuuacgaucuggcccuagacagcggucggccccauucccgugcugucuucaaugagacgaagaacucaacaagaaggcaaacccaggugcucgggcugacucagaccugcgaaacacuuaaauugcagcugccuaauugcauugaggauccaguuagcccgauagugcuccgccugaacuuuucuuuagucggaaccccucuguccgccuucggcaaccuucggccuguguuggcagaagacgcucaaagacucuuuacugcccuguucccauuugagaagaauugugguaacgauaauaucugccaggacgaucuaaguauuacauucagcuuuaugucucuggacugucucguugugggcgggcccagggaguucaacguaacggucaccgugcgaaaugauggagaagacuccuaccgcacucaggugacauuuuucuuuccucuggaucuuucauaucggaaagucaguaccuugcaaaaccagagaagccagaggucguggcgucuggcgugcgaguccgccucuagcacagaaguuucaggcgcuuuaaagaguacuuccuguucuaucaaucacccaaucuuccccgagaacagcgaagugaccuucaauauuacguuugacguagauuccaaggcaucacucgggaacaaacugcuucugaaggccaaugugaccagcgagaacaauaugccgcgcacaaacaaaacugaguuccaguuggaacucccugucaaguacgcuguguauaugguugugaccagucauggagucucuacaaaauaccugaauuuuacugccuccgagaacaccagccgggugaugcaacaccaguaucagguuucgaaccuaggccagagaucacugccaauaucucucguguuccugguccccguaaggcuuaaucaaacggugaucugggaccgaccucagguuacauuuagugaaaacuuguccucuaccugccauacuaaggagcggcugcccagccacagcgacuucuuagcagaacuccgcaaggcgccaguggucaauuguuccauugccgugugccagagaauccagugugauauucccuuuuucgguauccaagaggaauuuaacgcuacacugaaagggaaucuuucauucgacugguacauaaagaccagucacaaccaucugcuaaucguaagcacugccgagauucucuuuaaugauucuguguucacccuguugcccggacagggcgcauucgucaggucccagacagagacgaaaguugaaccauuugaggugccgaacccucugcccuuaaucguggguucaagugucggcgggcuccugcuucuggcuuugauuaccgccgcacucuauaagcugggauucuuuaaacggcaguacaaggacaugaugagcgaaggcgggccacccggagccgagccucaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6577 - RNA, 1680 nt, Artificial Sequence
  mRNA product Design5 comprising derived and/or modified sequence from Homo sapiens__NP_002415.1__HsMMP8 (opt3)
gggagagucccgcagucggcguccagcggcucugcuuguucgugugugugucguugcaggccuuauucaagcuuaccauguucagccugaagacccuccccuuucuucuguuguuacacgugcagaucuccaaagccuucccugucucuucaaaggagaaaaacacaaagacuguucaagacuaccuggaaaaauuuuaucagcuaccaaguaaucaguaccagagcacgagaaagaacggcaccaaugugauuguagagaagcucaaagaaaugcaaagguucuuugggcugaacgugacaggaaagccgaaugaggaaacucuugauaugaugaaaaagccccggugcggugucccugacuccggcggguucaugcugaccccaggaaaccccaaaugggagcgcacaaauuugaccuaucgaauacguaacuacacuccucagcucucugaggcugaaguggagagagcaaucaaggaugccuuugaacuguggucgguugcgucaccacugauuuucacaaggaucagccagggcgaggcugacauuaauaucgccuuuuaucagcgggaucauggugacaacagucccuucgaugggccuaauggaauacucgcacacgccuuucaaccaggccagggcaucgggggagacgcucauuucgaugcagaggaaaccuggacgaacacuuccgccaauuacaacuuauuucugguggcugcccacgaguucggucauucucuuggcuuggcgcacagcuccgacccgggggcacugauguaucccaauuacgccuuccgcgaaaccucaaacuacagucuaccucaggaugacauugauggaauccaggcuauuuauggccucagcucuaacccaauccaacccacagguccuuccacuccaaagcccugugacccgucacugaccuuugacgccauaacaacccuuagaggggagauucuguucuuuaaagauagguacuucuggcggcgccacccucaguugcagcgagucgaaaugaauuuuaucagccucuucuggcccagucugccaacgggcauucaagcagcuuaugaggacuuugauagagacuuaaucuuccuguuuaagggaaaccaguacugggcccucucuggcuaugauauccuucagggguacccuaaagacauuuccaauuauggauuccccagcucggugcaggcgauagaugccgcaguauuuuacaggucuaagacuuacuucuuuguuaacgaccaauucuggcgguaugauaaucagcgucaguucauggagccagguuaccccaaauccaucucaggcgcuuuuccugggauugaaaguaagguggacgccgucuuccagcaagagcacuuuuuccauguguuuagcggaccacgcuauuacgcuuucgaucugaucgcccagagagugacaagggucgcacggggcaacaaaugguugaauugccgauaugguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6578 - RNA, 2400 nt, Artificial Sequence
  mRNA product Design5 comprising derived and/or modified sequence from Homo sapiens__NP_004985.2__HsMMP9 (opt3)
gggagagucccgcagucggcguccagcggcucugcuuguucgugugugugucguugcaggccuuauucaagcuuaccaugagccuguggcagccccucgugcuuguccuguugguuuuaggcugcuguuucgccgcuccuagacaaaggcaguccacccuggugcuauuuccaggggaccuccggacaaaccugacugaucgccagcuugcagaggaauaccuguaucgauacggauauacgcguguagccgagaugagaggugaaucuaaaucauugggcccggcgcuccugcugcuccagaaacaauuaagucugcccgagaccggggaacuugacagcgcuacauugaaggccaugaggacuccucggugcggagugccagaucugggccgcuuccagaccuuugagggugaccuaaaauggcaccaucacaauaucacauacuggauucagaacuauuccgaggaucuccccagagcagucauagacgaugccuucgcuagggcauuugcccuguggucugcugugaccccucuuacuuucacacggguuuacucgcgcgacgccgauaucgugauucaguuuggggucgcggaacauggagacggcuauccauucgauggcaaggacgggcuguuggcacacgccuuucccccuggaccagguauccaaggcgaugcucauuucgacgacgaugagcucuggucacuggggaaaggagugguaguuccgacccgauuuggcaaugccgacggugcagcuugucacuuccccuuuauuuucgaagggagaagcuacagugccugcacgacugauggaagguccgacggcuuaccuugguguucuaccacagcgaacuacgauacugacgaucgguucggcuuuugcccaagcgagcgucuguauacccaggacgggaaugccgauggaaagcccugucaguucccuuuuaucuuccagggucaauccuacucagcaugcacaaccgacggccgcagugauggguauagauggugugcuacgacugccaacuacgacagggacaagcucuuuggauucugcccaacacgggcugauagcaccgugaugggcgguaauucugccggggagcuuugugucuuucccuucacuuuucugggcaaagaauauuccacaugcaccucagagggacgaggcgacgggcgcuuguggugcgcaacgaccagcaacuucgauagugacaagaaauggggauuuuguccggaucaggguuacucucuauuccugguggccgcucacgaauuuggccaugcgcucgggcuggaccacuccagcgugccugaggcacuuauguaucccauguacagauucacagaaggaccaccucugcauaaggaugacgucaauggcauaaggcacuuguacgguccccggccagagcccgagccucgcccaccgacuaccacaacuccccagccuaccgccccacccacaguuugcccuaccgggccacccacugugcacccgucggaaagaccuacggcuggcccaacaggacccccuucugccggccccaccgggccaccuacugcaggacccuccaccgccacaaccguaccacucucaccgguggaugacgcuuguaacgucaauaucuucgaugccauugcagagaucgguaaccaacuguauuuauuuaaagacggcaaguacuggagguucagugaagggcguggaagccggccucagggccccuuucugauugcggauaaguggccagcucuaccccgaaaacucgacuccguguucgaggaaagacugucuaagaaauuguuuuucuuuagcgguaggcagguuuggguguauacuggggccucaguccuuggcccucgccggcuggacaagcucggacugggcgcagauguggcccagguaacaggggcucuuagaaguggaaggggcaaaaugcuguuguucuccggucgccgacucuggcgguuugacguuaaggcccaaaugguggauccacguagcgcaucugaggucgacagaauguuccccggggugccucuggauacgcaugacgucuuucaguacagggagaaggcuuauuucugccaggaucgcuuuuacuggcgggugucaaguagaagcgaauuaaaucagguugaccaagugggauauguaaccuacgauauccugcaguguccggaggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6579 - RNA, 1692 nt, Artificial Sequence
  mRNA product Design5 comprising derived and/or modified sequence from Homo sapiens__NP_002418.1__HsMMP13 (opt3)
gggagagucccgcagucggcguccagcggcucugcuuguucgugugugugucguugcaggccuuauucaagcuuaccaugcaccccggcgugcuggccgcuuuccucuuucuuagcuggacccauugcagagcacugccuuugccauccgggggagacgaggaugacuuaucugaagaggaucugcaguucgccgaaagguaccuacggucauauuaccacccgacaaaccucgcggguauccugaaggagaaugcugccaguagcaugacugaacgccuucgagagaugcaauccuuuuucggccuggaggucacggggaaauuggacgauaacacccucgacguuaugaagaaaccccguuguggagugccugauguaggcgaauauaauguguuuccaagaacacugaaguggucuaaaaugaaccugacuuacaggauugucaauuauacccccgacaugacacauucggagguggaaaaggcauucaagaaagccuuuaagguuuggucagaugugaccccucucaacuucacucgguuacacgacgguauagcugauaucaugauuagcuuugggaucaaagagcauggagacuucuacccauuugauggccccaguggccugcuugcacacgccuucccuccagggccgaauuauggaggugacgcucacuuugacgaugacgagacauggaccuccucuagcaagggcuacaacuuguuccuggucgccgcgcaugaguucgggcacucccuaggacucgaucauucaaaagaccccggcgcacugauguuuccuauuuacacguauacugguaagagucacuucaugcuuccagaugacgaugugcaggggauccagagccuguacggacccggcgacgaagauccuaauccaaagcaccccaaaaccccggacaagugcgauccuucuuugucccucgacgccauaacaucacugcgcggcgaaacuaugaucuuuaaagacagauucuuuuggagguuacauccccagcaaguagaugcugagcuguuccucaccaagagcuuuuggccagaacuuccuaaccggauugacgccgcauaugagcaccccagucaugaucugaucuucauuuuucgcgggcgaaaauucugggcuuugaauggauacgacauccuagaggguuauccaaagaaaauaucugaacugggccuccccaaggagguuaagaaaauuuccgccgcggugcacuuugaagauacagggaagacccugcuuuucagcggaaaccaggucuggagauacgacgauacgaaucauaucauggacaaagauuauccuaggcugauugaggaagacuuuccaggcaucggugauaagguggacgccguguacgagaaaaacggguacaucuauuucuucaauggcccgauucaguuugaguacucgauauggucuaaccggaucguccguguuaugcccgcaaacuccauuuugugguguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6580 - RNA, 1344 nt, Artificial Sequence
  mRNA product Design5 comprising derived and/or modified sequence from Homo sapiens__NP_001286.1__HsCCR1 (opt3)
gggagagucccgcagucggcguccagcggcucugcuuguucgugugugugucguugcaggccuuauucaagcuuaccauggagacccccaacacaacugaagacuacgauacgaccacagaguucgacuauggcgaugccacuccuugccagaaggugaaugaaagagcuuuuggggcacaacugcucccaccgcuuuacagccuggucuucguuaucggauugguggguaacauuuuaguagugcugguccuagugcaguauaaaaggcucaagaauaugaccuccauauaccugcuuaaccuggccaucucugacuugcucuuucuguucacacugcccuuuuggauugauuauaaacucaaggacgauuggguuuucggcgacgcgauguguaaaaucuuaucaggguuuuacuauaccggacuguacagugagauuuucuuuaucauacuuuugacuaucgaucgguaccuggcuauugugcacgccgucuucgcacuacgcgcccgaacagugaccuuuggcguaaucacgagcauuaucauaugggcucucgcaauucuggccuccaugccuggucuuuauuucucuaagacucagugggaauuuacccaucacacaugcucgcugcauuucccacacgagucauugcgugaguggaaacucuuccaggcucugaaguuaaaucuguuugggcucguucuuccccuguuggugaugaucauuuguuacacuggaaucaucaagauucuacugagaaggccuaacgagaaaaagagcaaagccguccggcucauauucgugaucaugauuaucuuuuuccuguuuuggaccccauauaaucuuacaauacugauuaguguguuccaagacuuuuuguucacccaugaaugcgaacagucccgccaccucgaucuggcgguccagguuacggaggugaucgcauacacucacuguugcguaaaccccgugaucuaugccuuugucggcgagagauucaggaaguacuuacggcagcuguuucaucgccgaguggcuguucaccuagugaaguggcucccuuuccugucugucgacagacuugaaagggugagcuccacaucaccaaguaccggcgagcaugaauugagcgccggguuuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6581 - RNA, 912 nt, Artificial Sequence
  mRNA product Design5 comprising derived and/or modified sequence from Homo sapiens__NP_002598.4__HsPDGFA (opt3)
gggagagucccgcagucggcguccagcggcucugcuuguucgugugugugucguugcaggccuuauucaagcuuaccaugagaacccuggccugccuccuucuguugggauguggguacuuagcucacgugcuggcagaggaagccgagauccccagggaagucauugagcggcuagcgcgcagccagauacauuccauccgagaccuccaacgucugcuugaaauugauucuguuggaucagaggacagucuggauacuagcuugagagcucacggugugcaugccacaaagcacguaccugagaaaaggccacucccgauccggcgcaagagauccauugaagaggcagugcccgccgucugcaaaacgaggaccgugaucuaugaaauaccucggucucagguugacccaacaucggcuaacuuccugaucuggcccccuuguguggaggucaagcgcugcacuggcuguugcaauaccucaagcgugaaaugucagccaagucgaguacaucacagauccguuaagguggcaaaggucgaguacgugaggaaaaagcccaaacugaaggaagugcagguccggcucgaggaacacuuagagugcgccugugcuacaaccucucugaacccugauuaucgugaagaggacacugggcgcccaagagagagcggcaaaaagaggaagcggaaacgacuuaagccgacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6582 - RNA, 1002 nt, Artificial Sequence
  mRNA product Design5 comprising derived and/or modified sequence from Homo sapiens__NP_002599.1__HsPDGFB (opt3)
gggagagucccgcagucggcguccagcggcucugcuuguucgugugugugucguugcaggccuuauucaagcuuaccaugaacagaugcugggcccuguuccucagccuuuguugcuaccugagguugguguccgcugagggcgaccccaucccugaagaguuauaugaaaugcugucugaucacucaauucggaguuuugacgaucuacagcgccuccugcauggggacccaggagaggaagauggugcagagcuugaccugaauaugacccgaagccacuccggcggggaguuggaaucucucgcccguggaagaaggucgcugggcucacugacaauagcggagccggcuaugaucgccgaauguaagacucggacggaggucuucgagauuagccgcagacucaucgauaggaccaacgcaaacuuuuuaguuuggcccccuugcguggaaguacaacgguguagugguugcuguaauaaucgcaacgugcagugccgaccaacacagguccagcugagacccgugcaaguuaggaaaauugagaucgugcggaagaaaccuauauucaagaaagccacugucacccuugaagaccauuuggcuuguaagugcgagacaguggcagccgcucguccaguaacccgcucccccgggggaucucaggaacagagagccaagacuccucagacaaggguuaccauccggacggugcgaguccgcagaccaccgaaaggcaagcacaggaaauuuaagcauacucacgauaaaaccgcgcugaaggagacacuaggcgcaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6583 - RNA, 1314 nt, Artificial Sequence
  mRNA product Design5 comprising derived and/or modified sequence from Homo sapiens__NP_057289.1__HsPDGFC (opt3)
gggagagucccgcagucggcguccagcggcucugcuuguucgugugugugucguugcaggccuuauucaagcuuaccaugagccuguucggccuccuucuguugaccuccgccuuagcugggcagagacaaggaacacaggcagagucuaaccugucaaguaaguuucaguucagcuccaauaaagaacagaacggugugcaagacccccagcacgagaggaucauuacugucucuacgaauggcucgauacauucaccucgguuuccacacaccuacccgcgcaacacaguucuaguguggcgacucguagccguggaagagaaugucuggauccagcugacuuucgaugaacguuuugggcuugaggaccccgaggaugacauuugcaaguaugauuucguggaaguugaggaaccuagcgacggaaccauccugggcagauggugugguagugggacagugccaggaaaacagauuuccaagggcaaccaaaucaggauacgguuugucucugaugaguacuuccccagcgagccuggcuuuugcauccauuauaauauugugaugccacaguucaccgaagcgguaucccccucaguuuugccuccaagugcucucccgcuggaccugcucaacaaugccaucacugcauuuagcacauuagaggaucugauucgcuaccuugaacccgagagauggcaguuggaccuggaagaucuauauaggccuaccuggcagcuccuggggaaagccuucguguuuggacggaagucucgcgucguggaccuuaaccuguugacggaggaggugcgacucuacuccuguacuccaagaaauuucucagucagcaucagggaggaacugaagcggaccgauacaauauucuggcccgguugcuuacugguuaaacguuguggcgggaacugcgcuuguugccuccacaauuguaacgaaugccaaugugugccuaguaagguaacuaaaaaguaucaugaggugcuucagcugcgcccaaaaaccggagucagaggcuugcacaagucucuaacagacguggcacuggaacaccaugaggagugcgacugcguuuguagggguuccaccgggggaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6584 - RNA, 1371 nt, Artificial Sequence
  mRNA product Design5 comprising derived and/or modified sequence from Homo sapiens__NP_149126.1__HsPDGFD (opt3)
gggagagucccgcagucggcguccagcggcucugcuuguucgugugugugucguugcaggccuuauucaagcuuaccaugcacagacugaucuucguguacacccucauuugcgccaacuuuuguagcugcagggacacauccgcuacuccccagucugcaucaauaaaggcccuucggaaugcgaaccugcgccgagaugacuuguaucguagagaugagacgauccaagucaaaggaaauggguacguucagaguccuagguucccaaacagcuauccgcggaauuuacugcuaaccuggcgccuccauucccaggaaaacacaaggauucagcugguguuugacaaucaauucggacuugaggaagcugagaacgauaucuguagauacgacuuuguagaaguggaggauauuucugagacuucgaccaucauacggggucgcuggugcggccacaaggaagugcccccucgaaucaaaucaagaacaaaucagauuaagaucaccuucaaaagcgacgauuauuuugucgccaagccaggguucaagauuuacuauagucuguuggaggacuuucagcccgcagccgcuuccgaaacuaacugggagucuguuacaagcuccaucucaggagugaguuacaauagcccuucugucaccgauccaacgcucauagcagacgcccuggauaaaaagauugcugaguucgacacuguggaagaccugcucaaauacuuuaaccccgaguccuggcaggaagauuuagagaauauguaucuggacaccccuagguaccggggccguucauaucaugaucgcaagagcaaaguagaccuugauagauugaacgacgaugccaagagguacaguuguacaccacggaauuauucuguuaacauccgagaggaacugaagcuagcgaacguggucuucuuuccgcgcugccuccuggugcaaagauguggugggaauugcggauguggcacugugaacuggagguccugcaccuguaauagcggcaaaacagucaagaaauaccacgagguucuucaguucgaacccgggcauauuaagcggcgcggcagagcaaaaaccauggcccugguggacauccaguuggaucaccacgagaggugcgacugcaucuguucgucucguccuccacggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6585 - RNA, 954 nt, Artificial Sequence
  mRNA product Design5 comprising derived and/or modified sequence from Homo sapiens__NP_003946.3__HsSOCS3 (opt3)
gggagagucccgcagucggcguccagcggcucugcuuguucgugugugugucguugcaggccuuauucaagcuuaccauggugacccacagcaaguuccccgccgcuggcauguccagaccucuggacacaucucucaggcuuaaaacuuuuucaaguaagagcgaguaccagcuggucguuaacgcagugcggaaauugcaagaauccggguucuauuggucugccguaacgggaggugaggcgaauuuacugcuaucggcugaaccagccggcaccuuucucauccgcgauucaagcgaccagcgacauuucuuuacacugagugugaagacucaguccgggaccaaaaaccuucguauucagugcgagggaggcucuuucagccugcaauccgauccgagaucaacacagcccgucccuagguuugacuguguguugaagcucguucaccauuacaugccacccccuggugcaccaaguuuccccagcccuccaaccgaaccgucuuccgaggugcccgagcagccuucagcccagccacugcccgggagcccuccacggcgcgcuuauuacauauauaguggaggcgaaaagaucccccugguccucucuagaccguuauccagcaauguggcaacucugcaacaccuuugcaggaaaacaguaaacggccauuuggauucguacgagaagguuacccagcugccugggcccauucgggaauuucuagaccaguaugaugccccacucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6586 - RNA, 759 nt, Artificial Sequence
  mRNA product Design5 comprising derived and/or modified sequence from Homo sapiens__NP_003227.1__HsTGFA (opt3)
gggagagucccgcagucggcguccagcggcucugcuuguucgugugugugucguugcaggccuuauucaagcuuaccauggugcccagcgccggccagcuggcucucuucgcacuugggaucguccuggccgcgugccaggcuuuggagaacuccaccucuccuuuaucagccgacccaccgguugcagccgcugugguaagucacuuuaaugauugucccgacagccauacacaauucugcuuucacggaacuuguagauuccuggugcaggaagauaagccugcaugcgucugucauuccgguuacgugggcgccaggugcgagcacgcugaccuacucgccguuguggcggcaucucagaaaaagcaagccauuacggcucuggucgugguaucgauaguugcccuugcagugcugaucauuaccugugucuugauccauugcugucaggugcggaaacacugcgaauggugucgcgcucucauuugccgacacgagaagccaucagcccugcugaaagggcguacagcgugcugucauagcgaaacuguggucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6587 - RNA, 1449 nt, Artificial Sequence
  mRNA product Design5 comprising derived and/or modified sequence from Homo sapiens__NP_000651.3__HsTGFB1 (opt3)
gggagagucccgcagucggcguccagcggcucugcuuguucgugugugugucguugcaggccuuauucaagcuuaccaugcccccuagcggccugagacuccuuccacuguuguuaccgcugcuauggcuccuggugcuuacccccgggaggccugccgcuggacuguccacaugcaagacuaucgacauggaguuggucaaacggaagcgcauugaagcaauacgaggucagauccucucuaaacugcgucuggccucaccacccagucaaggcgagguuccuccagggccccucccugaagcgguguuagcucuguacaacagcacgagagauaggguagccggagaguccgcagaaccagagccggagcccgaagccgacuauuacgcuaaggaggugacccggguccuuaugguggaaacacacaaugagauuuaugauaaauucaagcagucuacucauucgaucuacauguuuuucaacaccucagaguugcgcgaagcaguuccugagccagugcugcuaagcagagccgaacucaggcugcuucggcugaaguugaaagucgagcagcacguggaacucuaucagaaguacaguaauaacuccuggcgcuaucugucuaaucgauuacuggcucccagcgacuccccugaguggcucucauuugauguaacaggcguugugagacaauggcuuaguagggguggggagauugaaggauuccggcugagcgcccauuguucuugcgacucccgugauaacaccuugcaggucgacaucaauggcuuuacuacaggccgcagaggggaucuagcgaccauacacggaaugaacaggccauuccugcuccugauggcaacgccccuugagcgggcccagcaucugcagucaagccgacaccgcagagcuuuggacacuaauuacuguuuuaguucuaccgagaaaaacugcugugugaggcaacucuacaucgauuuccggaaggaccuggguuggaaauggauucacgaaccgaagggcuaucaugccaauuuuugcuuagggccuugucccuacaucuggucccuggauacacaguauagcaaggugcuagcacucuacaaccagcacaauccaggagcuucggccgcgccuugcugugucccccaggcccuggaaccacuucccauuguuuauuacgugggccgcaaaccuaagguagagcaauugucuaacaugaucgugagauccugcaaauguucaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6588 - RNA, 1521 nt, Artificial Sequence
  mRNA product Design5 comprising derived and/or modified sequence from Homo sapiens__NP_003229.1__HsTGFB2 (opt3)
gggagagucccgcagucggcguccagcggcucugcuuguucgugugugugucguugcaggccuuauucaagcuuaccaugcacuacugcgugcugagcgccuuccucauccuucaucuggucaccguugcuuuguccuuaucuacauguucaacucuggacauggaucaguuuaugagaaagaggauugaggcaauacggggccaaauccuaaguaaacucaagcugacgagcccucccgaagacuauccagagccggaagaggugcccccugaaguaauuuccaucuacaacucuacccgcgaucuucugcaggagaaagccucgcgacgugcggcugccugcgagagagaaaggucagacgaggaauauuacgcaaaggagguguauaaaauugauaugccacccuucuuuccuagcgagaaugccaucccacccacauucuaccggccuuauuuucgcauagucagauucgacgugagugcuauggaaaagaacgcauccaauuugguuaaggccgaguuuaggguguuccggcuccagaacccaaaagcucgcgucccggaacagcgaaucgagcuguaccaaauucugaagucuaaagaucucacuagccccacccagagauacaucgacuccaaggugguaaaaacaagggccgaaggggagugguuaucauuugauguuaccgacgcggugcacgaguggcugcaucacaaggaucggaaucuuggauucaagauuaguuugcauuguccuugcuguacuuuugucccaagcaacaauuauaucauacccaacaaaucugaggaacuggaagcacguuucgccgguauugacggcacauccaccuacacgucaggggaucagaagacuaucaaaagcacccgcaagaaaaauaguggaaagacaccucaccuacuccugaugcuucugccaucuuauagauuggagucccagcaaacuaacaggcggaaaaagcgagcucucgacgccgcauacugcuuucgcaaugugcaggacaacuguugccugagacccuuauauauugauuucaagagggaccugggcuggaaauggauccacgaaccgaaggguuacaaugcuaacuucugugccggggcgugcccuuaucucuggagcucggauacccagcauucucgggugcuuucccuguacaauacaaucaaccccgaggccucagcaaguccauguugcgucagccaggacuuggagccucuaaccauucuguacuauauaggaaaaacgcccaagaucgaacaacucuccaacaugauuguuaaaucuugcaaguguagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6589 - RNA, 1515 nt, Artificial Sequence
  mRNA product Design5 comprising derived and/or modified sequence from Homo sapiens__NP_003230.1__HsTGFB3 (opt3)
gggagagucccgcagucggcguccagcggcucugcuuguucgugugugugucguugcaggccuuauucaagcuuaccaugaagaugcaucugcagagagcccucgugguccuugcucuguugaacuucgcaaccguuagcuuaucccugucuacaugcacuacgcuagacuuuggccacaucaaaaagaaaaggguggaggccauucgggggcaaauacucucaaagcugcgccuuaccagucccccugaaccaacaguaaugacucacgugccguaccagguccuggcguuguauaauagcacccgagagcuccuggaagagaugcauggagaacgugaggaggguuguacacaggaaaacaccgaguccgaauacuaugcuaaagagauccacaaguucgauaugauucagggccuggccgagcauaaugaacucgcagugugccccaaggggaucacuucuaaaguuuuuagauucaacgugucgucagucgagaagaauaggacaaacuuauuucgggccgaguuccgcgugcugagaguaccuaauccaagcaguaaaaggaacgaacaacggauugaacuuuuucagaucuugcgccccgacgagcacauagcuaagcagcgauacaucggaggcaaaaaucugccuaccagagguacggcagaguggcuauccuucgauguuacugacaccgugagggaauggcuccugcggcgugagucuaaccuugggcuggaaauuagcauccacuguccaugccauacauuucagcccaauggagauauuuuggagaacauccacgaagucauggagauaaaguucaagggcguggacaaugaggaugaccauggccgcggggaucucggaagacugaaaaagcaaaaagaccaccacaacccucauuuaauucugaugaugaucccaccgcacaggcucgauaaucccggucagggcgggcagcggaagaaacgagcccuugacacuaacuauuguuuucgcaaccuggaagagaauugcugugugagaccuuuguacauugauuucaggcaggaccuaggauggaaguggguccaugaaccaaaaggcuauuacgcuaacuuuugcuccggucccuguccuuaccugcggucagccgacaccacacacaguaccguucucgggcuguauaauacgcuuaacccagaggcgagcgcaucucccugcugugugccgcaagaucuggaaccuuugacuauccucuacuauguaggacgcacacccaagguggagcagcuguccaauauggucgugaagucaugcaaaugcagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6590 - RNA, 1662 nt, Artificial Sequence
  mRNA product Design5 comprising derived and/or modified sequence from Homo sapiens__NP_001057.1__HsTNFRSF1B (opt3)
gggagagucccgcagucggcguccagcggcucugcuuguucgugugugugucguugcaggccuuauucaagcuuaccauggcccccguggcugucugggcagcccuggcgguuggccucgagcuuugggcugccgcacacgcccugccugcucagguggcauucaccccauacgccccggaacccgggagcacaugcagauugagggaguauuacgaccaaacugcucagauguguugcuccaaguguucuccuggacagcaugccaaaguauuuugcacgaagaccucagauacagugugugacaguugcgaagauagcacuuauacccaguuauggaacugggucccagagugucuguccugcgguucucgguguucgucagaccaaguggaaacacaggcgugcacccgcgagcagaaucgaaucuguacuugccgucccggcugguacugcgcacuaagcaaacaggagggguguagacucugcgccccucugaggaagugucggccaggauucggcguugcucgccccgguacagaaaccagugauguggucugcaaaccuugugccccagggacguuuuccaacacuaccucuagcacagacauuugcagaccgcaccaaauauguaaugugguagcaauccccggaaacgcuuccauggaugccguuugcacuucaaccaguccuacaaggagcauggcgccaggcgccgugcaucuuccccagccugucucuacccggucccagcacacgcagccaacucccgagccgucaacagcaccuagcaccaguuuccuguugcccaugggcccaucuccucccgcugaaggguccacuggagacuuugcccucccagugggucugauugugggcgucacagcucuggggcucuuaaucauuggaguugugaauuguguaaucaugacccaagugaagaagaaaccccugugccuucagcgcgaggccaaggucccucauuugccagcagauaaagcccgaggcacgcaggguccggagcaacagcaucugcuaauaaccgcucccagcucgucuuccucaagucucgaaagcuccgcgucugcacuggacagaagggccccuacacggaaccagccacaggcucccgggguggaggccagcggagcaggcgaagcccgugcuucaacuggcaguuccgauagcucuccugggggacacgguacccaaguuaaugugacauguaucgucaacgugugcucaaguagcgaccacuccucucagugcucgagccaggccuccucaacuaugggcgauaccgacaguucuccaagcgagucccccaaggacgaacagguaccguucucaaaagaggagugugcauuucgcagccaacuugaaacaccugagacccuguuggggucuacugaagagaagccacucccccugggaguuccugaugcgggcaugaagcccuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6591 - RNA, 789 nt, Artificial Sequence
  mRNA product Design5 comprising derived and/or modified sequence from Homo sapiens__NP_002623.2__HsPGF (opt3)
gggagagucccgcagucggcguccagcggcucugcuuguucgugugugugucguugcaggccuuauucaagcuuaccaugcccgugaugagacuguucccuugcuuucuccagcuucuggccggcuuggcuuuaccagcagucccgccccaacagugggcccugagcgcggggaacggauccucugagguugaagugguaccuuuccaggaggugugggguaggucauacugucgggcucuagaacgccucgucgacgugguuagugaguauccaagcgaaguggagcacauguuuucccccucuugcgucucgcugcuucgauguaccggcugcuguggggaugagaaucugcauugcgugccuguagaaacagccaacguuacuaugcaguugcucaagauccguucaggagacagaccaagcuacguggagcugacguucagucaacacgucaggugugaaugccggccccugcgcgagaaaaugaagccugagagaaggcggccaaaaggccgcgguaagcgaagaagggaaaaacagcggccgaccgauugucaucucugcggggacgcagugccccgucgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6592 - RNA, 1515 nt, Artificial Sequence
  mRNA product Design5 comprising derived and/or modified sequence from Homo sapiens__NP_001020537.2__HsVEGFA (opt3)
gggagagucccgcagucggcguccagcggcucugcuuguucgugugugugucguugcaggccuuauucaagcuuaccaugaccgacagacagacagauacugcccccagcccuuccuaccaucugcucccaggcaggcggcgcacgguggacgcugcagccucucgagggcaaggaccggagcccgcgccugguggcggggucgaaggaguuggcgcucgugguguggcccuuaagcuguucguacaguuguuagggugcucaagauuuggaggcgcaguggucagggccggcgaggcugaaccaaguggggcagcccggagcgcuuccucuggacgcgaggaaccccagccugaggagggugaagaggaagaggagaaagaagaggaaagaggcccacaguggaggcugggggcccggaagcccggaucguggaccggcgaggcggcagugugugccgauucagcuccugccgcacgcgcuccacaagcccuagcgcgagccagcgguagagggggaaggguugcacggcguggcgcugaagagaguggcccgccccacuccccuucucgcagagggagcgccuccagggcuggaccaggucgggccucagagacaaugaacuuccuccugaguugggugcacuggagccuugcacuguugcucuaucugcaucacgccaaauggucucaggcugcgcccauggcagaaggcgggggacagaaucaucacgaggucgugaaguuuauggacguauaccagcgauccuauugccacccuaucgaaacucugguugauauuuuccaagaguacccagacgaaauagaguauaucuuuaaacccucaugugugccgcucaugcgcugcggcgguuguugcaacgaugagggguuagaaugugucccuaccgaggaaagcaauauuacaaugcagaucaugagaauuaagccccaucagggccagcacaucggagagaugaguuuccugcaacauaacaagugcgaauguaggccuaaaaaggaccgggcccgccaggagaaaaagucugugagaggcaaagggaagggacagaagaggaaacguaagaaaucccgguacaagagcuggucgguguaugucggugcucgaugcugucuuaugccauggucuuugcccggcccacaccccugcgggccuugcuccgagagaaggaaacaccuguuuguucaagauccacagaccuguaagugcucauguaaaaauacugacagucgcugcaaggcccggcagcuagaacucaacgagagaacauguaggugcgauaagccgcgccgaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6593 - RNA, 975 nt, Artificial Sequence
  mRNA product Design5 comprising derived and/or modified sequence from Homo sapiens__NP_001165094.1__HsVEGFA (opt3)
gggagagucccgcagucggcguccagcggcucugcuuguucgugugugugucguugcaggccuuauucaagcuuaccaugaacuuccugcucagcugggugcacuggucccuugcccuguuguuauaccugcaucacgcuaaguggucucaggcagcccccauggcggagggcgggggacaaaaucaucacgaagucguuaaauuuauggacguguaucagagaucauacugccauccuaucgagacccuaguagauauuuuccaggaauauccagacgagauagaauacaucuuuaagccgaguugugugccccucaugaggugcgguggcuguugcaacgaugaggggcuggagugugucccuacagaagagagcaauauuacuaugcagaucaugcggauuaaaccacaccaaggacagcacaucggcgaaauguccuuccuucagcauaacaagugcgagugucgccccaaaaaggaccgagcucgucaggagaagaaaucugugagagguaaggggaaaggacaaaagaggaaacggaagaagucgcgcuauaaaucauggagcguuuacgugggcgccagaugcugucugaugccuuggaguuugccaggcccccacccuugcgggccauguuccgaaaggcggaagcaucucuuuguccaggauccgcagacgugcaaaugcucuuguaagaauaccgacagccgcugcaaagcacgacagcuggagcugaacgaaagaacauguaggugcgauaagccccggcguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6594 - RNA, 900 nt, Artificial Sequence
  mRNA product Design5 comprising derived and/or modified sequence from Homo sapiens__NP_003368.1__HsVEGFB (opt3)
gggagagucccgcagucggcguccagcggcucugcuuguucgugugugugucguugcaggccuuauucaagcuuaccaugagcccccugcucagaaggcuucuguuggccgcuuuacugcagcuagccccugcacaagcgccagugucccagccggacgcucccggccaccagcggaaggucguuucuuggaucgauguguacacccgcgccacaugccagccucgagagguaguggucccacucacuguggaacugauggggacgguugcaaaacaacuugugcccucaugugucaccgugcagcguugcggagguuguugcccugacgauggccuggaguguguaccaacagggcagcaucagguuagaaugcaaauuuugaugauaagguaucccaguagccagcucggagaaaugucccuggaggaacacucucagugcgagugucggccuaagaaaaaggacucggccgugaaaccagaucgcgcugcaacuccgcaucacagaccccagccuaggucagucccaggcugggacagcgcccccggugcuccuaguccagccgauaucacccaucccacaccggcgccugggcccuccgcacacgccgcuccaucuaccacuagcgcccugacaccuggacccgcagcugccgcggccgacgcagcugccuccucaguggcuaagggcggcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6595 - RNA, 1536 nt, Artificial Sequence
  mRNA product Design5 comprising derived and/or modified sequence from Homo sapiens__NP_005420.1__HsVEGFC (opt3)
gggagagucccgcagucggcguccagcggcucugcuuguucgugugugugucguugcaggccuuauucaagcuuaccaugcaccuucucggcuucuuuagcguggccugcucccuucuggcugcagccuuguuacccgggccuagagaggcgccagcugccgcagccgcuuucgaaucuggacuggaccuaucagaugcagagccggacgccggugaagcuaccgccuacgcgaguaaggaucucgaggaacagcugaggagcgucuccucuguugacgagcuuaugacagugcuguaucccgaguacuggaaaauguauaagugucaauugcggaaaggcggguggcagcauaaccgcgaacaggcaaaucucaacucgcgaacugaggaaacgaucaaguuugccgcugcccacuacaauaccgagauucugaaaucaauagauaacgaguggcguaagacacagugcaugccuagagaaguauguaucgacgugggaaaggaguucggcgucgcaacuaauaccuuuuucaaaccacccugcgugagcguuuauagguguggugggugcuguaacagugaaggacugcaaugcaugaauacauccaccucuuaccucagcaagacuuuauuugagauuacagugccucugucccagggcccaaaacccgucaccaucucauucgcuaaccauacgaguugucggugcaugagcaagcuggauguguaucgccagguacacucuauuaucagaagguccuugccugccacucugccacagugucaagcggccaauaaaaccugcccgacaaacuacauguggaauaaccauauaugccggugucuagcacaggaagacuuuauguucucaagcgaugcuggcgacgauaguacugacggguuucacgauaucugcggacccaauaaggagcucgacgaggaaaccugucagugcguuugucgcgccggucugcgaccugcuucuugcggcccacacaaggagcuugacagaaacuccugucagugcguguguaaaaauaagcuguuccccagccaaugcggggccaacagggaauuugaugagaacacaugucagugcgucugcaaacggaccuguccucguaaucagccauugaaccccggaaagugcgcaugugaaugcacggagucgccgcaaaaaugucuccugaagggcaaaaaguuccaucaccagacuugcucuuguuaccgcagaccuugcacaaauaggcagaaggccugugagcccgguuucuccuauucagaagaggugugccggugugugccaaguuacuggaaacgaccucagaugagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6596 - RNA, 1341 nt, Artificial Sequence
  mRNA product Design5 comprising derived and/or modified sequence from Homo sapiens__NP_004460.1__HsVEGFD (opt3)
gggagagucccgcagucggcguccagcggcucugcuuguucgugugugugucguugcaggccuuauucaagcuuaccauguacagagaguggguggucguuaacguguucaugaugcuguauguacagcucgugcaaggcagcuccaaugaacacgggcccgucaagaggucuucacagaguacccuugagcggagcgaacagcagauccgcgccgcuuccucucuggaggaauuguuacgaauuacacauucggaggacuggaaacuguggcguugcagacuaaggcucaagucauuuacuagcauggauagucgguccgcaucucaccgcagcacgagauucgccgcgaccuuuuacgacauagagacacugaaagugaucgaugaagaguggcaaaggacucaguguuccccucgggaaaccugcguugagguggcuucagagcuuggaaagaguacaaacaccuucuuuaaaccaccgugugucaauguguuccgcugcgguggcuguugcaacgaagagagccugauuuguaugaauacuucuacauccuauaucucaaagcaguuguuugaaauuagcguaccccucaccaguguuccugagcuggugccagucaagguggccaaccauacggggugcaaaugucugcccacugcaccucgacacccauacucuaucauaagaagguccauccagauucccgaagaggaccggugcagccauucgaagaaacucuguccuaucgauauguuaugggacucuaauaagugcaaaugcgugcugcaagaggaaaacccacuugccggaaccgaggaucacucccacuugcaggaaccggcucuguguggcccccauaugauguucgacgaggaucguugcgaaugugucugcaagacaccuuguccaaaggaccuaauucagcaccccaaaaauugcucauguuuugagugcaaggagagucucgaaacuuguugccagaaacauaagcuguuccacccugauaccuguagcugcgaggaccgcugcccauuucacacaagacccugugcauccgguaaaaccgccugcgcuaagcauuguagguucccgaaagaaaagcgggccgcgcaagggccucacucucgaaagaaccccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6597 - RNA, 906 nt, Artificial Sequence
  mRNA product Design5 comprising derived and/or modified sequence from Homo sapiens__NP_061986.1__HsFGF21 (opt4)
gggagagucccgcagucggcguccagcggcucugcuuguucgugugugugucguugcaggccuuauucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagcugcugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggccccagccagggcagaagccccagcuacgccagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6598 - RNA, 1686 nt, Artificial Sequence
  mRNA product Design5 comprising derived and/or modified sequence from Homo sapiens__NP_002412.1__HsMMP1 (opt4)
gggagagucccgcagucggcguccagcggcucugcuuguucgugugugugucguugcaggccuuauucaagcuuaccaugcacagcuuccccccccugcugcugcugcuguucuggggcguggugagccacagcuuccccgccacccuggagacccaggagcaggacguggaccuggugcagaaguaccuggagaaguacuacaaccugaagaacgacggcagacagguggagaagagaagaaacagcggccccgugguggagaagcugaagcagaugcaggaguucuucggccugaaggugaccggcaagcccgacgccgagacccugaaggugaugaagcagcccagaugcggcgugcccgacguggcccaguucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6599 - RNA, 1446 nt, Artificial Sequence
  mRNA product Design5 comprising derived and/or modified sequence from Homo sapiens__NP_002412.1__HsMMP1(1-19,100-469) (opt4)
gggagagucccgcagucggcguccagcggcucugcuuguucgugugugugucguugcaggccuuauucaagcuuaccaugcacagcuuccccccccugcugcugcugcuguucuggggcguggugagccacagcuucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6600 - RNA, 3633 nt, Artificial Sequence
  mRNA product Design5 comprising derived and/or modified sequence from Clostridium histolyticum__BAA77453.1__ColG (opt4)
gggagagucccgcagucggcguccagcggcucugcuuguucgugugugugucguugcaggccuuauucaagcuuaccaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6601 - RNA, 3357 nt, Artificial Sequence
  mRNA product Design5 comprising derived and/or modified sequence from Clostridium histolyticum__BAA77453.1__HsALB(1-18)_ColG(111-1118) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6602 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6603 - RNA, 3381 nt, Artificial Sequence
  mRNA product Design5 comprising derived and/or modified sequence from Clostridium histolyticum__BAA34542.1__ColH (opt4)
gggagagucccgcagucggcguccagcggcucugcuuguucgugugugugucguugcaggccuuauucaagcuuaccaugaacuuccugaagaucauccugaacagaggcaagaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6604 - RNA, 3342 nt, Artificial Sequence
  mRNA product Design5 comprising derived and/or modified sequence from Clostridium histolyticum__BAA34542.1__ColH (opt4)
gggagagucccgcagucggcguccagcggcucugcuuguucgugugugugucguugcaggccuuauucaagcuuaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6605 - RNA, 3276 nt, Artificial Sequence
  mRNA product Design5 comprising derived and/or modified sequence from Clostridium histolyticum__BAA34542.1__HsALB(1-18)_ColH(41-1021) (opt4)
gggagagucccgcagucggcguccagcggcucugcuuguucgugugugugucguugcaggccuuauucaagcuuaccaugaagugggugaccuucaucagccugcuguuccuguucagcagcgccuacagcgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6606 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaugaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6607 - RNA, 852 nt, Artificial Sequence
  mRNA product Design5 comprising derived and/or modified sequence from Homo sapiens__NP_001133.1__HsAMELX (opt4)
gggagagucccgcagucggcguccagcggcucugcuuguucgugugugugucguugcaggccuuauucaagcuuaccaugggcaccuggauccuguucgccugccugcugggcgccgccuucgccaugccccugcccccccaccccggccaccccggcuacaucaacuucagcuacgaggugcugaccccccugaagugguaccagagcaucagaccccccuaccccagcuacggcuacgagcccaugggcggcuggcugcaccaccagaucauccccgugcugagccagcagcacccccccacccacacccugcagccccaccaccacauccccguggugcccgcccagcagcccgugaucccccagcagcccaugaugcccgugcccggccagcacagcaugacccccauccagcaccaccagcccaaccugcccccccccgcccagcagcccuaccagccccagcccgugcagccccagccccaccagcccaugcagccccagccccccgugcaccccaugcagccccugcccccccagcccccccugccccccauguuccccaugcagccccugccccccaugcugcccgaccugacccuggaggccuggcccagcaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6608 - RNA, 411 nt, Artificial Sequence
  mRNA product Design5 comprising derived and/or modified sequence from Homo sapiens__NP_001133.1__HsAMELX-TRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagagcaucagaccccccuaccccagcuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6609 - RNA, 444 nt, Artificial Sequence
  mRNA product Design5 comprising derived and/or modified sequence from Homo sapiens__NP_001133.1__HsAMELX-LRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagagcaucagacccccccccaugcugcccgaccugacccuggaggccuggcccagcaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6610 - RNA, 483 nt, Artificial Sequence
  mRNA product Design5 comprising derived and/or modified sequence from Homo sapiens__NP_001133.1__HLA-A2-SP_HsAMELX(17-60) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaucagaccccccuaccccagcuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6611 - RNA, 516 nt, Artificial Sequence
  mRNA product Design5 comprising derived and/or modified sequence from Homo sapiens__NP_001133.1__HLA-A2-SP_HsAMELX(17-47,168-191) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaucagacccccccccaugcugcccgaccugacccuggaggccuggcccagcaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6612 - RNA, 855 nt, Artificial Sequence
  mRNA product Design5 comprising derived and/or modified sequence from Homo sapiens__NP_001134.1__HsAMELY (opt4)
gggagagucccgcagucggcguccagcggcucugcuuguucgugugugugucguugcaggccuuauucaagcuuaccaugggcaccuggauccuguucgccugccuggugggcgccgccuucgccaugccccugcccccccaccccggccaccccggcuacaucaacuucagcuacgaggugcugaccccccugaagugguaccagagcaugaucagaccccccuacagcagcuacggcuacgagcccaugggcggcuggcugcaccaccagaucauccccguggugagccagcagcacccccugacccacacccugcagagccaccaccacauccccguggugcccgcccagcagcccagagugagacagcaggcccugaugcccgugcccggccagcagagcaugacccccacccagcaccaccagcccaaccugccccugcccgcccagcagcccuuccagccccagcccgugcagccccagccccaccagcccaugcagccccagccccccgugcagcccaugcagccccugcugccccagcccccccugccccccauguucccccugagaccccugccccccauccugcccgaccugcaccuggaggccuggcccgccaccgacaagaccaagcaggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6613 - RNA, 414 nt, Artificial Sequence
  mRNA product Design5 comprising derived and/or modified sequence from Homo sapiens__NP_001134.1__HsAMELY-TRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagagcaugaucagaccccccuacagcagcuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6614 - RNA, 447 nt, Artificial Sequence
  mRNA product Design5 comprising derived and/or modified sequence from Homo sapiens__NP_001134.1__HsAMELY-LRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagagcaugaucagacccccccccauccugcccgaccugcaccuggaggccuggcccgccaccgacaagaccaagcaggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6615 - RNA, 486 nt, Artificial Sequence
  mRNA product Design5 comprising derived and/or modified sequence from Homo sapiens__NP_001134.1__HLA-A2-SP_HsAMELY(17-61) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaugaucagaccccccuacagcagcuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6616 - RNA, 519 nt, Artificial Sequence
  mRNA product Design5 comprising derived and/or modified sequence from Homo sapiens__NP_001134.1__HLA-A2-SP_HsAMELY(17-48,169-192) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaugaucagacccccccccauccugcccgaccugcaccuggaggccuggcccgccaccgacaagaccaagcaggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6617 - RNA, 846 nt, Artificial Sequence
  mRNA product Design5 comprising derived and/or modified sequence from Sus scrofa__NP_999071.1__SsAMELX-001-1 (opt4)
gggagagucccgcagucggcguccagcggcucugcuuguucgugugugugucguugcaggccuuauucaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6618 - RNA, 414 nt, Artificial Sequence
  mRNA product Design5 comprising derived and/or modified sequence from Sus scrofa__NP_999071.1__SsAMELX-TRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagaacaugaucagacaccccuacaccagcuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6619 - RNA, 447 nt, Artificial Sequence
  mRNA product Design5 comprising derived and/or modified sequence from Sus scrofa__NP_999071.1__SsAMELX-LRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6620 - RNA, 486 nt, Artificial Sequence
  mRNA product Design5 comprising derived and/or modified sequence from Sus scrofa__NP_999071.1__HLA-A2-SP_SsAMEL(17-61) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagaacaugaucagacaccccuacaccagcuacggcuacgagcccaugggcggcuggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6621 - RNA, 519 nt, Artificial Sequence
  mRNA product Design5 comprising derived and/or modified sequence from Sus scrofa__NP_999071.1__HLA-A2-SP_SsAMEL(17-49,167-189) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6622 - RNA, 810 nt, Artificial Sequence
  mRNA product Design5 comprising derived and/or modified sequence from Sus scrofa__P45561-2__SsAMELX-001-2 (opt4)
gggagagucccgcagucggcguccagcggcucugcuuguucgugugugugucguugcaggccuuauucaagcuuaccaugggcaccuggauccuguucgccugccugcugggcgccgccuucagcaugccccugcccccccaccccggccaccccggcuacaucaacuucagcuacaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6623 - RNA, 846 nt, Artificial Sequence
  mRNA product Design5 comprising derived and/or modified sequence from Sus scrofa__NP_998965.1__SsAMELX-001-3 (opt4)
gggagagucccgcagucggcguccagcggcucugcuuguucgugugugugucguugcaggccuuauucaagcuuaccaugggcaccuggaucuucuucgccugccugcugggcgccagccuggccaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6624 - RNA, 495 nt, Artificial Sequence
  mRNA product Design5 comprising derived and/or modified sequence from Sus scrofa__K7GPB2__SsAMELX-002 (opt4)
gggagagucccgcagucggcguccagcggcucugcuuguucgugugugugucguugcaggccuuauucaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6625 - RNA, 888 nt, Artificial Sequence
  mRNA product Design5 comprising derived and/or modified sequence from Sus scrofa__K7GLD0__SsAMELX-003 (opt4)
gggagagucccgcagucggcguccagcggcucugcuuguucgugugugugucguugcaggccuuauucaagcuuaccaugggcaccuggauccuguucgccugccugcugggcgccgccuucagcaugccccugcccccccaccccggccaccccggcuacaucaacuucagcuacgaggaccuguaccuggaggccaucagaaucgacagaaccgccuucgugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6626 - RNA, 774 nt, Artificial Sequence
  mRNA product Design5 comprising derived and/or modified sequence from Sus scrofa__K7GPE9__SsAMELX-004 (opt4)
gggagagucccgcagucggcguccagcggcucugcuuguucgugugugugucguugcaggccuuauucaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6627 - RNA, 798 nt, Artificial Sequence
  mRNA product Design5 comprising derived and/or modified sequence from Sus scrofa__J9JIM4__SsAMELX-201 (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6628 - RNA, 3237 nt, Artificial Sequence
  mRNA product Design5 comprising derived and/or modified sequence from Homo sapiens__NP_006120.1__HsBMP1 (opt4)
gggagagucccgcagucggcguccagcggcucugcuuguucgugugugugucguugcaggccuuauucaagcuuaccaugcccggcguggccagacugccccugcugcugggccugcugcugcugcccagacccggcagaccccuggaccuggccgacuacaccuacgaccuggccgaggaggacgacagcgagccccugaacuacaaggaccccugcaaggccgccgccuuccugggcgacaucgcccuggacgaggaggaccugagagccuuccaggugcagcaggccguggaccugagaagacacaccgccagaaagagcagcaucaaggccgccgugcccggcaacaccagcacccccagcugccagagcaccaacggccagccccagagaggcgccugcggcagauggagaggcagaagcagaagcagaagagccgccaccagcagacccgagagaguguggcccgacggcgugauccccuucgugaucggcggcaacuucaccggcagccagagagccguguucagacaggccaugagacacugggagaagcacaccugcgugaccuuccuggagagaaccgacgaggacagcuacaucguguucaccuacagacccugcggcugcugcagcuacgugggcagaagaggcggcggcccccaggccaucagcaucggcaagaacugcgacaaguucggcaucguggugcacgagcugggccacguggugggcuucuggcacgagcacaccagacccgacagagacagacacgugagcaucgugagagagaacauccagcccggccaggaguacaacuuccugaagauggagccccaggagguggagagccugggcgagaccuacgacuucgacagcaucaugcacuacgccagaaacaccuucagcagaggcaucuuccuggacaccaucgugcccaaguacgaggugaacggcgugaagccccccaucggccagagaaccagacugagcaagggcgacaucgcccaggccagaaagcuguacaagugccccgccugcggcgagacccugcaggacagcaccggcaacuucagcagccccgaguaccccaacggcuacagcgcccacaugcacugcguguggagaaucagcgugacccccggcgagaagaucauccugaacuucaccagccuggaccuguacagaagcagacugugcugguacgacuacguggaggugagagacggcuucuggagaaaggccccccugagaggcagauucugcggcagcaagcugcccgagcccaucgugagcaccgacagcagacuguggguggaguucagaagcagcagcaacugggugggcaagggcuucuucgccguguacgaggccaucugcggcggcgacgugaagaaggacuacggccacauccagagccccaacuaccccgacgacuacagacccagcaaggugugcaucuggagaauccaggugagcgagggcuuccacgugggccugaccuuccagagcuucgagaucgagagacacgacagcugcgccuacgacuaccuggaggugagagacggccacagcgagagcagcacccugaucggcagauacugcggcuacgagaagcccgacgacaucaagagcaccagcagcagacuguggcugaaguucgugagcgacggcagcaucaacaaggccggcuucgccgugaacuucuucaaggagguggacgagugcagcagacccaacagaggcggcugcgagcagagaugccugaacacccugggcagcuacaagugcagcugcgaccccggcuacgagcuggcccccgacaagagaagaugcgaggccgccugcggcggcuuccugaccaagcugaacggcagcaucaccagccccggcuggcccaaggaguacccccccaacaagaacugcaucuggcagcugguggcccccacccaguacagaaucagccugcaguucgacuucuucgagaccgagggcaacgacgugugcaaguacgacuucguggaggugagaagcggccugaccgccgacagcaagcugcacggcaaguucugcggcagcgagaagcccgaggugaucaccagccaguacaacaacaugagaguggaguucaagagcgacaacaccgugagcaagaagggcuucaaggcccacuucuucagcgacaaggacgagugcagcaaggacaacggcggcugccagcaggacugcgugaacaccuucggcagcuacgagugccagugcagaagcggcuucgugcugcacgacaacaagcacgacugcaaggaggccggcugcgaccacaaggugaccagcaccagcggcaccaucaccagccccaacuggcccgacaaguaccccagcaagaaggagugcaccugggccaucagcagcacccccggccacagagugaagcugaccuucauggagauggacaucgagagccagcccgagugcgccuacgaccaccuggagguguucgacggcagagacgccaaggcccccgugcugggcagauucugcggcagcaagaagcccgagcccgugcuggccaccggcagcagaauguuccugagauucuacagcgacaacagcgugcagagaaagggcuuccaggccagccacgccaccgagugcggcggccaggugagagccgacgugaagaccaaggaccuguacagccacgcccaguucggcgacaacaacuaccccggcggcguggacugcgagugggugaucguggccgaggagggcuacggcguggagcugguguuccagaccuucgagguggaggaggagaccgacugcggcuacgacuacauggagcuguucgacggcuacgacagcaccgcccccagacugggcagauacugcggcagcggcccccccgaggagguguacagcgccggcgacagcgugcuggugaaguuccacagcgacgacaccaucaccaagaagggcuuccaccugagauacaccagcaccaaguuccaggacacccugcacagcagaaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6629 - RNA, 1467 nt, Artificial Sequence
  mRNA product Design5 comprising derived and/or modified sequence from Homo sapiens__NP_001191.1__HsBMP2 (opt4)
gggagagucccgcagucggcguccagcggcucugcuuguucgugugugugucguugcaggccuuauucaagcuuaccaugguggccggcaccagaugccugcuggcccugcugcugccccaggugcugcugggcggcgccgccggccuggugcccgagcugggcagaagaaaguucgccgccgccagcagcggcagacccagcagccagcccagcgacgaggugcugagcgaguucgagcugagacugcugagcauguucggccugaagcagagacccacccccagcagagacgccguggugccccccuacaugcuggaccuguacagaagacacagcggccagcccggcagccccgcccccgaccacagacuggagagagccgccagcagagccaacaccgugagaagcuuccaccacgaggagagccuggaggagcugcccgagaccagcggcaagaccaccagaagauucuucuucaaccugagcagcauccccaccgaggaguucaucaccagcgccgagcugcagguguucagagagcagaugcaggacgcccugggcaacaacagcagcuuccaccacagaaucaacaucuacgagaucaucaagcccgccaccgccaacagcaaguuccccgugaccagacugcuggacaccagacuggugaaccagaacgccagcagaugggagagcuucgacgugacccccgccgugaugagauggaccgcccagggccacgccaaccacggcuucgugguggagguggcccaccuggaggagaagcagggcgugagcaagagacacgugagaaucagcagaagccugcaccaggacgagcacagcuggagccagaucagaccccugcuggugaccuucggccacgacggcaagggccacccccugcacaagagagagaagagacaggccaagcacaagcagagaaagagacugaagagcagcugcaagagacacccccuguacguggacuucagcgacgugggcuggaacgacuggaucguggccccccccggcuaccacgccuucuacugccacggcgagugccccuucccccuggccgaccaccugaacagcaccaaccacgccaucgugcagacccuggugaacagcgugaacagcaagauccccaaggccugcugcgugcccaccgagcugagcgccaucagcaugcuguaccuggacgagaacgagaagguggugcugaagaacuaccaggacauggugguggagggcugcggcugcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6630 - RNA, 1503 nt, Artificial Sequence
  mRNA product Design5 comprising derived and/or modified sequence from Homo sapiens__NP_001193.2__HsBMP4 (opt4)
gggagagucccgcagucggcguccagcggcucugcuuguucgugugugugucguugcaggccuuauucaagcuuaccaugauccccggcaacagaaugcugaugguggugcugcugugccaggugcugcugggcggcgccagccacgccagccugauccccgagaccggcaagaagaagguggccgagauccagggccacgccggcggcagaagaagcggccagagccacgagcugcugagagacuucgaggccacccugcugcagauguucggccugagaagaagaccccagcccagcaagagcgccgugauccccgacuacaugagagaccuguacagacugcagagcggcgaggaggaggaggagcagauccacagcaccggccuggaguaccccgagagacccgccagcagagccaacaccgugagaagcuuccaccacgaggagcaccuggagaacauccccggcaccagcgagaacagcgccuucagauuccuguucaaccugagcagcauccccgagaacgaggugaucagcagcgccgagcugagacuguucagagagcagguggaccagggccccgacugggagagaggcuuccacagaaucaacaucuacgaggugaugaagccccccgccgagguggugcccggccaccugaucaccagacugcuggacaccagacuggugcaccacaacgugaccagaugggagaccuucgacgugagccccgccgugcugagauggaccagagagaagcagcccaacuacggccuggccaucgaggugacccaccugcaccagaccagaacccaccagggccagcacgugagaaucagcagaagccugccccagggcagcggcaacugggcccagcugagaccccugcuggugaccuucggccacgacggcagaggccacgcccugaccagaagaagaagagccaagagaagccccaagcaccacagccagagagccagaaagaagaacaagaacugcagaagacacagccuguacguggacuucagcgacgugggcuggaacgacuggaucguggccccccccggcuaccaggccuucuacugccacggcgacugccccuucccccuggccgaccaccugaacagcaccaaccacgccaucgugcagacccuggugaacagcgugaacagcagcauccccaaggccugcugcgugcccaccgagcugagcgccaucagcaugcuguaccuggacgaguacgacaagguggugcugaagaacuaccaggagauggugguggagggcugcggcugcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6631 - RNA, 1818 nt, Artificial Sequence
  mRNA product Design5 comprising derived and/or modified sequence from Homo sapiens__NP_001709.1__HsBMP6 (opt4)
gggagagucccgcagucggcguccagcggcucugcuuguucgugugugugucguugcaggccuuauucaagcuuaccaugcccggccugggcagaagagcccaguggcugugcuggugguggggccugcugugcagcugcugcggcccccccccccugagacccccccugcccgccgccgccgccgccgccgccggcggccagcugcugggcgacggcggcagccccggcagaaccgagcagcccccccccagcccccagagcagcagcggcuuccuguacagaagacugaagacccaggagaagagagagaugcagaaggagauccugagcgugcugggccugccccacagacccagaccccugcacggccugcagcagccccagccccccgcccugagacagcaggaggagcagcagcagcagcagcagcugcccagaggcgagcccccccccggcagacugaagagcgccccccuguucaugcuggaccuguacaacgcccugagcgccgacaacgacgaggacggcgccagcgagggcgagagacagcagagcuggccccacgaggccgccagcagcagccagagaagacagcccccccccggcgccgcccacccccugaacagaaagagccugcuggcccccggcagcggcagcggcggcgccagcccccugaccagcgcccaggacagcgccuuccugaacgacgccgacauggugaugagcuucgugaaccugguggaguacgacaaggaguucagccccagacagagacaccacaaggaguucaaguucaaccugagccagauccccgagggcgagguggugaccgccgccgaguucagaaucuacaaggacugcgugaugggcagcuucaagaaccagaccuuccugaucagcaucuaccaggugcugcaggagcaccagcacagagacagcgaccuguuccugcuggacaccagaguggugugggccagcgaggagggcuggcuggaguucgacaucaccgccaccagcaaccuguggguggugaccccccagcacaacaugggccugcagcugagcguggugaccagagacggcgugcacgugcaccccagagccgccggccuggugggcagagacggccccuacgacaagcagcccuucaugguggccuucuucaaggugagcgaggugcacgugagaaccaccagaagcgccagcagcagaagaagacagcagagcagaaacagaagcacccagagccaggacguggccagagugagcagcgccagcgacuacaacagcagcgagcugaagaccgccugcagaaagcacgagcuguacgugagcuuccaggaccugggcuggcaggacuggaucaucgcccccaagggcuacgccgccaacuacugcgacggcgagugcagcuucccccugaacgcccacaugaacgccaccaaccacgccaucgugcagacccuggugcaccugaugaaccccgaguacgugcccaagcccugcugcgcccccaccaagcugaacgccaucagcgugcuguacuucgacgacaacagcaacgugauccugaagaaguacagaaacaugguggugagagccugcggcugccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6632 - RNA, 1572 nt, Artificial Sequence
  mRNA product Design5 comprising derived and/or modified sequence from Homo sapiens__NP_001710.1__HsBMP7 (opt4)
gggagagucccgcagucggcguccagcggcucugcuuguucgugugugugucguugcaggccuuauucaagcuuaccaugcacgugagaagccugagagccgccgccccccacagcuucguggcccugugggccccccuguuccugcugagaagcgcccuggccgacuucagccuggacaacgaggugcacagcagcuucauccacagaagacugagaagccaggagagaagagagaugcagagagagauccugagcauccugggccugccccacagacccagaccccaccugcagggcaagcacaacagcgcccccauguucaugcuggaccuguacaacgccauggccguggaggagggcggcggccccggcggccagggcuucagcuaccccuacaaggccguguucagcacccagggccccccccuggccagccugcaggacagccacuuccugaccgacgccgacauggugaugagcuucgugaaccugguggagcacgacaaggaguucuuccaccccagauaccaccacagagaguucagauucgaccugagcaagauccccgagggcgaggccgugaccgccgccgaguucagaaucuacaaggacuacaucagagagagauucgacaacgagaccuucagaaucagcguguaccaggugcugcaggagcaccugggcagagagagcgaccuguuccugcuggacagcagaacccugugggccagcgaggagggcuggcugguguucgacaucaccgccaccagcaaccacuggguggugaaccccagacacaaccugggccugcagcugagcguggagacccuggacggccagagcaucaaccccaagcuggccggccugaucggcagacacggcccccagaacaagcagcccuucaugguggccuucuucaaggccaccgaggugcacuucagaagcaucagaagcaccggcagcaagcagagaagccagaacagaagcaagacccccaagaaccaggaggcccugagaauggccaacguggccgagaacagcagcagcgaccagagacaggccugcaagaagcacgagcuguacgugagcuucagagaccugggcuggcaggacuggaucaucgcccccgagggcuacgccgccuacuacugcgagggcgagugcgccuucccccugaacagcuacaugaacgccaccaaccacgccaucgugcagacccuggugcacuucaucaaccccgagaccgugcccaagcccugcugcgcccccacccagcugaacgccaucagcgugcuguacuucgacgacagcagcaacgugauccugaagaaguacagaaacaugguggugagagccugcggcugccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6633 - RNA, 576 nt, Artificial Sequence
  mRNA product Design5 comprising derived and/or modified sequence from Homo sapiens__NP_006264.2__HsCCL7 (opt4)
gggagagucccgcagucggcguccagcggcucugcuuguucgugugugugucguugcaggccuuauucaagcuuaccaugaaggccagcgccgcccugcugugccugcugcugaccgccgccgccuucagcccccagggccuggcccagcccgugggcaucaacaccagcaccaccugcugcuacagauucaucaacaagaagauccccaagcagagacuggagagcuacagaagaaccaccagcagccacugccccagagaggccgugaucuucaagaccaagcuggacaaggagaucugcgccgaccccacccagaagugggugcaggacuucaugaagcaccuggacaagaagacccagacccccaagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6634 - RNA, 3900 nt, Artificial Sequence
  mRNA product Design5 comprising derived and/or modified sequence from Homo sapiens__NP_001954.2__HsEGF (opt4)
gggagagucccgcagucggcguccagcggcucugcuuguucgugugugugucguugcaggccuuauucaagcuuaccaugcugcugacccugaucauccugcugcccguggugagcaaguucagcuucgugagccugagcgccccccagcacuggagcugccccgagggcacccuggccggcaacggcaacagcaccugcgugggccccgcccccuuccugaucuucagccacggcaacagcaucuucagaaucgacaccgagggcaccaacuacgagcagcuggugguggacgccggcgugagcgugaucauggacuuccacuacaacgagaagagaaucuacuggguggaccuggagagacagcugcugcagagaguguuccugaacggcagcagacaggagagagugugcaacaucgagaagaacgugagcggcauggccaucaacuggaucaacgaggaggugaucuggagcaaccagcaggagggcaucaucaccgugaccgacaugaagggcaacaacagccacauccugcugagcgcccugaaguaccccgccaacguggccguggaccccguggagagauucaucuucuggagcagcgagguggccggcagccuguacagagccgaccuggacggcgugggcgugaaggcccugcuggagaccagcgagaagaucaccgccgugagccuggacgugcuggacaagagacuguucuggauccaguacaacagagagggcagcaacagccugaucugcagcugcgacuacgacggcggcagcgugcacaucagcaagcaccccacccagcacaaccuguucgccaugagccuguucggcgacagaaucuucuacagcaccuggaagaugaagaccaucuggaucgccaacaagcacaccggcaaggacauggugagaaucaaccugcacagcagcuucgugccccugggcgagcugaagguggugcacccccuggcccagcccaaggccgaggacgacaccugggagcccgagcagaagcugugcaagcugagaaagggcaacugcagcagcaccgugugcggccaggaccugcagagccaccugugcaugugcgccgagggcuacgcccugagcagagacagaaaguacugcgaggacgugaacgagugcgccuucuggaaccacggcugcacccugggcugcaagaacacccccggcagcuacuacugcaccugccccgugggcuucgugcugcugcccgacggcaagagaugccaccagcuggugagcugccccagaaacgugagcgagugcagccacgacugcgugcugaccagcgagggcccccugugcuucugccccgagggcagcgugcuggagagagacggcaagaccugcagcggcugcagcagccccgacaacggcggcugcagccagcugugcgugccccugagccccgugagcugggagugcgacugcuuccccggcuacgaccugcagcuggacgagaagagcugcgccgccagcggcccccagcccuuccugcuguucgccaacagccaggacaucagacacaugcacuucgacggcaccgacuacggcacccugcugagccagcagaugggcaugguguacgcccuggaccacgaccccguggagaacaagaucuacuucgcccacaccgcccugaaguggaucgagagagccaacauggacggcagccagagagagagacugaucgaggagggcguggacgugcccgagggccuggccguggacuggaucggcagaagauucuacuggaccgacagaggcaagagccugaucggcagaagcgaccugaacggcaagagaagcaagaucaucaccaaggagaacaucagccagcccagaggcaucgccgugcaccccauggccaagagacuguucuggaccgacaccggcaucaaccccagaaucgagagcagcagccugcagggccugggcagacuggugaucgccagcagcgaccugaucuggcccagcggcaucaccaucgacuuccugaccgacaagcuguacuggugcgacgccaagcagagcgugaucgagauggccaaccuggacggcagcaagagaagaagacugacccagaacgacgugggccaccccuucgccguggccguguucgaggacuacgugugguucagcgacugggccaugcccagcgugaugagagugaacaagagaaccggcaaggacagagugagacugcagggcagcaugcugaagcccagcagccuggugguggugcacccccuggccaagcccggcgccgaccccugccuguaccagaacggcggcugcgagcacaucugcaagaagagacugggcaccgccuggugcagcugcagagagggcuucaugaaggccagcgacggcaagaccugccuggcccuggacggccaccagcugcuggccggcggcgagguggaccugaagaaccaggugaccccccuggacauccugagcaagaccagagugagcgaggacaacaucaccgagagccagcacaugcugguggccgagaucauggugagcgaccaggacgacugcgcccccgugggcugcagcauguacgccagaugcaucagcgagggcgaggacgccaccugccagugccugaagggcuucgccggcgacggcaagcugugcagcgacaucgacgagugcgagaugggcgugcccgugugcccccccgccagcagcaagugcaucaacaccgagggcggcuacgugugcagaugcagcgagggcuaccagggcgacggcauccacugccuggacaucgacgagugccagcugggcgagcacagcugcggcgagaacgccagcugcaccaacaccgagggcggcuacaccugcaugugcgccggcagacugagcgagcccggccugaucugccccgacagcaccccccccccccaccugagagaggacgaccaccacuacagcgugagaaacagcgacagcgagugcccccugagccacgacggcuacugccugcacgacggcgugugcauguacaucgaggcccuggacaaguacgccugcaacugcguggugggcuacaucggcgagagaugccaguacagagaccugaaguggugggagcugagacacgccggccacggccagcagcagaaggugaucgugguggccgugugcgugguggugcuggugaugcugcugcugcugagccuguggggcgcccacuacuacagaacccagaagcugcugagcaagaaccccaagaaccccuacgaggagagcagcagagacgugagaagcagaagacccgccgacaccgaggacggcaugagcagcugcccccagcccugguucguggugaucaaggagcaccaggaccugaagaacggcggccagcccguggccggcgaggacggccaggccgccgacggcagcaugcagcccaccagcuggagacaggagccccagcugugcggcaugggcaccgagcagggcugcuggauccccgugagcagcgacaagggcagcugcccccaggugauggagagaagcuuccacaugcccagcuacggcacccagacccuggagggcggcguggagaagccccacagccugcugagcgccaacccccuguggcagcagagagcccuggaccccccccaccagauggagcugacccagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6635 - RNA, 786 nt, Artificial Sequence
  mRNA product Design5 comprising derived and/or modified sequence from Homo sapiens__NP_001423.1__HsEREG (opt4)
gggagagucccgcagucggcguccagcggcucugcuuguucgugugugugucguugcaggccuuauucaagcuuaccaugaccgccggcagaagaauggagaugcugugcgccggcagagugcccgcccugcugcugugccugggcuuccaccugcugcaggccgugcugagcaccaccgugauccccagcugcauccccggcgagagcagcgacaacugcaccgcccuggugcagaccgaggacaaccccagaguggcccaggugagcaucaccaagugcagcagcgacaugaacggcuacugccugcacggccagugcaucuaccugguggacaugagccagaacuacugcagaugcgaggugggcuacaccggcgugagaugcgagcacuucuuccugaccgugcaccagccccugagcaaggaguacguggcccugaccgugauccugaucauccuguuccugaucaccguggugggcagcaccuacuacuucugcagaugguacagaaacagaaagagcaaggagcccaagaaggaguacgagagagugaccagcggcgaccccgagcugccccaggugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6636 - RNA, 744 nt, Artificial Sequence
  mRNA product Design5 comprising derived and/or modified sequence from Homo sapiens__NP_000791.1__HsFGF1 (opt4)
gggagagucccgcagucggcguccagcggcucugcuuguucgugugugugucguugcaggccuuauucaagcuuaccauggccgagggcgagaucaccaccuucaccgcccugaccgagaaguucaaccugccccccggcaacuacaagaagcccaagcugcuguacugcagcaacggcggccacuuccugagaauccugcccgacggcaccguggacggcaccagagacagaagcgaccagcacauccagcugcagcugagcgccgagagcgugggcgagguguacaucaagagcaccgagaccggccaguaccuggccauggacaccgacggccugcuguacggcagccagacccccaacgaggagugccuguuccuggagagacuggaggagaaccacuacaacaccuacaucagcaagaagcacgccgagaagaacugguucgugggccugaagaagaacggcagcugcaagagaggccccagaacccacuacggccagaaggccauccuguuccugccccugcccgugagcagcgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6637 - RNA, 1143 nt, Artificial Sequence
  mRNA product Design5 comprising derived and/or modified sequence from Homo sapiens__NP_001997.5__HsFGF2 (opt4)
gggagagucccgcagucggcguccagcggcucugcuuguucgugugugugucguugcaggccuuauucaagcuuaccauggugggcgugggcggcggcgacguggaggacgugacccccagacccggcggcugccagaucagcggcagaggcgccagaggcugcaacggcauccccggcgccgccgccugggaggccgcccugcccagaagaagacccagaagacaccccagcgugaaccccagaagcagagccgccggcagccccagaaccagaggcagaagaaccgaggagagacccagcggcagcagacugggcgacagaggcagaggcagagcccugcccggcggcagacugggcggcagaggcagaggcagagcccccgagagagugggcggcagaggcagaggcagaggcaccgccgcccccagagccgcccccgccgccagaggcagcagacccggccccgccggcaccauggccgccggcagcaucaccacccugcccgcccugcccgaggacggcggcagcggcgccuucccccccggccacuucaaggaccccaagagacuguacugcaagaacggcggcuucuuccugagaauccaccccgacggcagaguggacggcgugagagagaagagcgacccccacaucaagcugcagcugcaggccgaggagagaggcguggugagcaucaagggcgugugcgccaacagauaccuggccaugaaggaggacggcagacugcuggccagcaagugcgugaccgacgagugcuucuucuucgagagacuggagagcaacaacuacaacaccuacagaagcagaaaguacaccagcugguacguggcccugaagagaaccggccaguacaagcugggcagcaagaccggccccggccagaaggccauccuguuccugcccaugagcgccaagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6638 - RNA, 861 nt, Artificial Sequence
  mRNA product Design5 comprising derived and/or modified sequence from Homo sapiens__NP_002000.1__HsFGF7 (opt4)
gggagagucccgcagucggcguccagcggcucugcuuguucgugugugugucguugcaggccuuauucaagcuuaccaugcacaaguggauccugaccuggauccugcccacccugcuguacagaagcugcuuccacaucaucugccuggugggcaccaucagccuggccugcaacgacaugacccccgagcagauggccaccaacgugaacugcagcagccccgagagacacaccagaagcuacgacuacauggagggcggcgacaucagagugagaagacuguucugcagaacccagugguaccugagaaucgacaagagaggcaaggugaagggcacccaggagaugaagaacaacuacaacaucauggagaucagaaccguggccgugggcaucguggccaucaagggcguggagagcgaguucuaccuggccaugaacaaggagggcaagcuguacgccaagaaggagugcaacgaggacugcaacuucaaggagcugauccuggagaaccacuacaacaccuacgccagcgccaaguggacccacaacggcggcgagauguucguggcccugaaccagaagggcauccccgugagaggcaagaagaccaagaaggagcagaagaccgcccacuuccugcccauggccaucaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6639 - RNA, 903 nt, Artificial Sequence
  mRNA product Design5 comprising derived and/or modified sequence from Homo sapiens__NP_001936.1__HsHBEGF (opt4)
gggagagucccgcagucggcguccagcggcucugcuuguucgugugugugucguugcaggccuuauucaagcuuaccaugaagcugcugcccagcguggugcugaagcuguuccuggccgccgugcugagcgcccuggugaccggcgagagccuggagagacugagaagaggccuggccgccggcaccagcaaccccgacccccccaccgugagcaccgaccagcugcugccccugggcggcggcagagacagaaaggugagagaccugcaggaggccgaccuggaccugcugagagugacccugagcagcaagccccaggcccuggccacccccaacaaggaggagcacggcaagagaaagaagaagggcaagggccugggcaagaagagagaccccugccugagaaaguacaaggacuucugcauccacggcgagugcaaguacgugaaggagcugagagcccccagcugcaucugccaccccggcuaccacggcgagagaugccacggccugagccugcccguggagaacagacuguacaccuacgaccacaccaccauccuggccgugguggccguggugcugagcagcgugugccugcuggugaucgugggccugcugauguucagauaccacagaagaggcggcuacgacguggagaacgaggagaaggugaagcugggcaugaccaacagccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6640 - RNA, 2463 nt, Artificial Sequence
  mRNA product Design5 comprising derived and/or modified sequence from Homo sapiens__NP_000592.3__HsHGF (opt4)
gggagagucccgcagucggcguccagcggcucugcuuguucgugugugugucguugcaggccuuauucaagcuuaccaugugggugaccaagcugcugcccgcccugcugcugcagcacgugcugcugcaccugcugcugcugcccaucgccauccccuacgccgagggccagagaaagagaagaaacaccauccacgaguucaagaagagcgccaagaccacccugaucaagaucgaccccgcccugaagaucaagaccaagaaggugaacaccgccgaccagugcgccaacagaugcaccagaaacaagggccugcccuucaccugcaaggccuucguguucgacaaggccagaaagcagugccugugguuccccuucaacagcaugagcagcggcgugaagaaggaguucggccacgaguucgaccuguacgagaacaaggacuacaucagaaacugcaucaucggcaagggcagaagcuacaagggcaccgugagcaucaccaagagcggcaucaagugccagcccuggagcagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccugauggaccacaccgagagcggcaagaucugccagagaugggaccaccagaccccccacagacacaaguuccugcccgagagauaccccgacaagggcuucgacgacaacuacugcagaaaccccgacggccagcccagacccuggugcuacacccuggacccccacaccagaugggaguacugcgccaucaagaccugcgccgacaacaccaugaacgacaccgacgugccccuggagaccaccgagugcauccagggccagggcgagggcuacagaggcaccgugaacaccaucuggaacggcauccccugccagagaugggacagccaguacccccacgagcacgacaugacccccgagaacuucaagugcaaggaccugagagagaacuacugcagaaaccccgacggcagcgagagccccuggugcuucaccaccgaccccaacaucagagugggcuacugcagccagauccccaacugcgacaugagccacggccaggacugcuacagaggcaacggcaagaacuacaugggcaaccugagccagaccagaagcggccugaccugcagcaugugggacaagaacauggaggaccugcacagacacaucuucugggagcccgacgccagcaagcugaacgagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccaccagaaccaacaucggcuggauggugagccugagauacagaaacaagcacaucugcggcggcagccugaucaaggagagcugggugcugaccgccagacagugcuuccccagcagagaccugaaggacuacgaggccuggcugggcauccacgacgugcacggcagaggcgacgagaagugcaagcaggugcugaacgugagccagcugguguacggccccgagggcagcgaccuggugcugaugaagcuggccagacccgccgugcuggacgacuucgugagcaccaucgaccugcccaacuacggcugcaccauccccgagaagaccagcugcagcguguacggcuggggcuacaccggccugaucaacuacgacggccugcugagaguggcccaccuguacaucaugggcaacgagaagugcagccagcaccacagaggcaaggugacccugaacgagagcgagaucugcgccggcgccgagaagaucggcagcggccccugcgagggcgacuacggcggcccccuggugugcgagcagcacaagaugagaauggugcugggcgugaucgugcccggcagaggcugcgccauccccaacagacccggcaucuucgugagaguggccuacuacgccaaguggauccacaagaucauccugaccuacaaggugccccagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6641 - RNA, 2202 nt, Artificial Sequence
  mRNA product Design5 comprising derived and/or modified sequence from Homo sapiens__NP_005336.3 __HsHSPA1A (opt4)
gggagagucccgcagucggcguccagcggcucugcuuguucgugugugugucguugcaggccuuauucaagcuuaccauggccaaggccgccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggcccugaacccccagaacaccguguucgacgccaagagacugaucggcagaaaguucggcgaccccguggugcagagcgacaugaagcacuggcccuuccaggugaucaacgacggcgacaagcccaaggugcaggugagcuacaagggcgagaccaaggccuucuaccccgaggagaucagcagcauggugcugaccaagaugaaggagaucgccgaggccuaccugggcuaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacagaaccggcaagggcgagagaaacgugcugaucuucgaccugggcggcggcaccuucgacgugagcauccugaccaucgacgacggcaucuucgaggugaaggccaccgccggcgacacccaccugggcggcgaggacuucgacaacagacuggugaaccacuucguggaggaguucaagagaaagcacaagaaggacaucagccagaacaagagagccgugagaagacugagaaccgccugcgagagagccaagagaacccugagcagcagcacccaggccagccuggagaucgacagccuguucgagggcaucgacuucuacaccagcaucaccagagccagauucgaggagcugugcagcgaccuguucagaagcacccuggagcccguggagaaggcccugagagacgccaagcuggacaaggcccagauccacgaccuggugcuggugggcggcagcaccagaauccccaaggugcagaagcugcugcaggacuucuucaacggcagagaccugaacaagagcaucaaccccgacgaggccguggccuacggcgccgccgugcaggccgccauccugaugggcgacaagagcgagaacgugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgagcugagcggcaucccccccgcccccagaggcgugccccagaucgaggugaccuucgacaucgacgccaacggcauccugaacgugaccgccaccgacaagagcaccggcaaggccaacaagaucaccaucaccaacgacaagggcagacugagcaaggaggagaucgagagaauggugcaggaggccgagaaguacaaggccgaggacgaggugcagagagagagagugagcgccaagaacgcccuggagagcuacgccuucaacaugaagagcgccguggaggacgagggccugaagggcaagaucagcgaggccgacaagaagaaggugcuggacaagugccaggaggugaucagcuggcuggacgccaacacccuggccgagaaggacgaguucgagcacaagagaaaggagcuggagcaggugugcaaccccaucaucagcggccuguaccagggcgccggcggccccggccccggcggcuucggcgcccagggccccaagggcggcagcggcagcggccccaccaucgaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6642 - RNA, 2202 nt, Artificial Sequence; identical to SEQ ID NO: 6641
  mRNA product Design5 comprising derived and/or modified sequence from Homo sapiens__NP_005337.2 __HsHSPA1B (opt4)

SEQ ID NO: 6643 - RNA, 2202 nt, Artificial Sequence
  mRNA product Design5 comprising derived and/or modified sequence from Homo sapiens__NP_005518.3 __HsHSPA1L (opt4)
gggagagucccgcagucggcguccagcggcucugcuuguucgugugugugucguugcaggccuuauucaagcuuaccauggccaccgccaagggcaucgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaacccccagaacaccguguucgacgccaagagacugaucggcagaaaguucaacgaccccguggugcaggccgacaugaagcuguggcccuuccaggugaucaacgagggcggcaagcccaaggugcuggugagcuacaagggcgagaacaaggccuucuaccccgaggagaucagcagcauggugcugaccaagcugaaggagaccgccgaggccuuccugggccaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacaagggcggccagggcgagagacacgugcugaucuucgaccugggcggcggcaccuucgacgugagcauccugaccaucgacgacggcaucuucgaggugaaggccaccgccggcgacacccaccugggcggcgaggacuucgacaacagacuggugagccacuucguggaggaguucaagagaaagcacaagaaggacaucagccagaacaagagagccgugagaagacugagaaccgccugcgagagagccaagagaacccugagcagcagcacccaggccaaccuggagaucgacagccuguacgagggcaucgacuucuacaccagcaucaccagagccagauucgaggagcugugcgccgaccuguucagaggcacccuggagcccguggagaaggcccugagagacgccaagauggacaaggccaagauccacgacaucgugcuggugggcggcagcaccagaauccccaaggugcagagacugcugcaggacuacuucaacggcagagaccugaacaagagcaucaaccccgacgaggccguggccuacggcgccgccgugcaggccgccauccugaugggcgacaagagcgagaaggugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgaccugaccggcaucccccccgcccccagaggcgugccccagaucgaggugaccuucgacaucgacgccaacggcauccugaacgugaccgccaccgacaagagcaccggcaaggugaacaagaucaccaucaccaacgacaagggcagacugagcaaggaggagaucgagagaauggugcuggacgccgagaaguacaaggccgaggacgaggugcagagagagaagaucgccgccaagaacgcccuggagagcuacgccuucaacaugaagagcguggugagcgacgagggccugaagggcaagaucagcgagagcgacaagaacaagauccuggacaagugcaacgagcugcugagcuggcuggaggugaaccagcuggccgagaaggacgaguucgaccacaagagaaaggagcuggagcagaugugcaaccccaucaucaccaagcuguaccagggcggcugcaccggccccgccugcggcaccggcuacgugcccggcagacccgccaccggccccaccaucgaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6644 - RNA, 2196 nt, Artificial Sequence
  mRNA product Design5 comprising derived and/or modified sequence from Homo sapiens__NP_068814.2 __HsHSPA2 (opt4)
gggagagucccgcagucggcguccagcggcucugcuuguucgugugugugucguugcaggccuuauucaagcuuaccaugagcgccagaggccccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccaucuucgacgccaagagacugaucggcagaaaguucgaggacgccaccgugcagagcgacaugaagcacuggcccuucagaguggugagcgagggcggcaagcccaaggugcagguggaguacaagggcgagaccaagaccuucuuccccgaggagaucagcagcauggugcugaccaagaugaaggagaucgccgaggccuaccugggcggcaaggugcacagcgccgugaucaccgugcccgccuacuucaacgacagccagagacaggccaccaaggacgccggcaccaucaccggccugaacgugcugagaaucaucaacgagcccaccgccgccgccaucgccuacggccuggacaagaagggcugcgccggcggcgagaagaacgugcugaucuucgaccugggcggcggcaccuucgacgugagcauccugaccaucgaggacggcaucuucgaggugaagagcaccgccggcgacacccaccugggcggcgaggacuucgacaacagaauggugagccaccuggccgaggaguucaagagaaagcacaagaaggacaucggccccaacaagagagccgugagaagacugagaaccgccugcgagagagccaagagaacccugagcagcagcacccaggccagcaucgagaucgacagccuguacgagggcguggacuucuacaccagcaucaccagagccagauucgaggagcugaacgccgaccuguucagaggcacccuggagcccguggagaaggcccugagagacgccaagcuggacaagggccagauccaggagaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugaucggcgacaagagcgagaacgugcaggaccugcugcugcuggacgugaccccccugagccugggcaucgagaccgccggcggcgugaugaccccccugaucaagagaaacaccaccauccccaccaagcagacccagaccuucaccaccuacagcgacaaccagagcagcgugcuggugcagguguacgagggcgagagagccaugaccaaggacaacaaccugcugggcaaguucgaccugaccggcaucccccccgcccccagaggcgugccccagaucgaggugaccuucgacaucgacgccaacggcauccugaacgugaccgccgccgacaagagcaccggcaaggagaacaagaucaccaucaccaacgacaagggcagacugagcaaggacgacaucgacagaauggugcaggaggccgagagauacaagagcgaggacgaggccaacagagacagaguggccgccaagaacgcccuggagagcuacaccuacaacaucaagcagaccguggaggacgagaagcugagaggcaagaucagcgagcaggacaagaacaagauccuggacaagugccaggaggugaucaacuggcuggacagaaaccagauggccgagaaggacgaguacgagcacaagcagaaggagcuggagagagugugcaaccccaucaucagcaagcuguaccagggcggccccggcggcggcagcggcggcggcggcagcggcgccagcggcggccccaccaucgaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6645 - RNA, 2799 nt, Artificial Sequence
  mRNA product Design5 comprising derived and/or modified sequence from Homo sapiens__NP_002145.3 __HsHSPA4 (opt4)
gggagagucccgcagucggcguccagcggcucugcuuguucgugugugugucguugcaggccuuauucaagcuuaccaugagcguggugggcaucgaccugggcuuccagagcugcuacguggccguggccagagccggcggcaucgagaccaucgccaacgaguacagcgacagaugcacccccgccugcaucagcuucggccccaagaacagaagcaucggcgccgccgccaagagccaggugaucagcaacgccaagaacaccgugcagggcuucaagagauuccacggcagagccuucagcgaccccuucguggaggccgagaagagcaaccuggccuacgacaucgugcagcugcccaccggccugaccggcaucaaggugaccuacauggaggaggagagaaacuucaccaccgagcaggugaccgccaugcugcugagcaagcugaaggagaccgccgagagcgugcugaagaagcccgugguggacugcguggugagcgugcccugcuucuacaccgacgccgagagaagaagcgugauggacgccacccagaucgccggccugaacugccugagacugaugaacgagaccaccgccguggcccuggccuacggcaucuacaagcaggaccugcccgcccuggaggagaagcccagaaacgugguguucguggacaugggccacagcgccuaccaggugagcgugugcgccuucaacagaggcaagcugaaggugcuggccaccgccuucgacaccacccugggcggcagaaaguucgacgaggugcuggugaaccacuucugcgaggaguucggcaagaaguacaagcuggacaucaagagcaagaucagagcccugcugagacugagccaggagugcgagaagcugaagaagcugaugagcgccaacgccagcgaccugccccugagcaucgagugcuucaugaacgacguggacgugagcggcaccaugaacagaggcaaguuccuggagaugugcaacgaccugcuggccagaguggagcccccccugagaagcgugcuggagcagaccaagcugaagaaggaggacaucuacgccguggagaucgugggcggcgccaccagaauccccgccgugaaggagaagaucagcaaguucuucggcaaggagcugagcaccacccugaacgccgacgaggccgugaccagaggcugcgcccugcagugcgccauccugagccccgccuucaaggugagagaguucagcaucaccgacguggugcccuaccccaucagccugagauggaacagccccgccgaggagggcagcagcgacugcgagguguucagcaagaaccacgccgcccccuucagcaaggugcugaccuucuacagaaaggagcccuucacccuggaggccuacuacagcagcccccaggaccugcccuaccccgaccccgccaucgcccaguucagcgugcagaaggugaccccccagagcgacggcagcagcagcaaggugaaggugaaggugagagugaacgugcacggcaucuucagcgugagcagcgccagccugguggaggugcacaagagcgaggagaacgaggagcccauggagaccgaccagaacgccaaggaggaggagaagaugcagguggaccaggaggagccccacguggaggagcagcagcagcagacccccgccgagaacaaggccgagagcgaggagauggagaccagccaggccggcagcaaggacaagaagauggaccagcccccccaggccaagaaggccaaggugaagaccagcaccguggaccugcccaucgagaaccagcugcuguggcagaucgacagagagaugcugaaccuguacaucgagaacgagggcaagaugaucaugcaggacaagcuggagaaggagagaaacgacgccaagaacgccguggaggaguacguguacgagaugagagacaagcugagcggcgaguacgagaaguucgugagcgaggacgacagaaacagcuucacccugaagcuggaggacaccgagaacuggcuguacgaggacggcgaggaccagcccaagcagguguacguggacaagcuggccgagcugaagaaccugggccagcccaucaagaucagauuccaggagagcgaggagagacccaagcuguucgaggagcugggcaagcagauccagcaguacaugaagaucaucagcagcuucaagaacaaggaggaccaguacgaccaccuggacgccgccgacaugaccaagguggagaagagcaccaacgaggccauggaguggaugaacaacaagcugaaccugcagaacaagcagagccugaccauggaccccguggugaagagcaaggagaucgaggccaagaucaaggagcugaccagcaccugcagccccaucaucagcaagcccaagcccaagguggagccccccaaggaggagcagaagaacgccgagcagaacggccccguggacggccagggcgacaaccccggcccccaggccgccgagcagggcaccgacaccgccgugcccagcgacagcgacaagaagcugcccgagauggacaucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6646 - RNA, 2796 nt, Artificial Sequence
  mRNA product Design5 comprising derived and/or modified sequence from Homo sapiens__NP_055093.2 __HsHSPA4L (opt4)
gggagagucccgcagucggcguccagcggcucugcuuguucgugugugugucguugcaggccuuauucaagcuuaccaugagcguggugggcaucgaccugggcuuccugaacugcuacaucgccguggccagaagcggcggcaucgagaccaucgccaacgaguacagcgacagaugcacccccgccugcaucagccugggcagcagaaccagagccaucggcaacgccgccaagagccagaucgugaccaacgugagaaacaccauccacggcuucaagaagcugcacggcagaagcuucgacgaccccaucgugcagaccgagagaaucagacugcccuacgagcugcagaagaugcccaacggcagcgccggcgugaaggugagauaccuggaggaggagagacccuucgccaucgagcaggugaccggcaugcugcuggccaagcugaaggagaccagcgagaacgcccugaagaagcccguggccgacugcgugaucagcauccccagcuucuucaccgacgccgagagaagaagcgugauggccgccgcccagguggccggccugaacugccugagacugaugaacgagaccaccgccguggcccuggccuacggcaucuacaagcaggaccugcccccccuggacgagaagcccagaaacgugguguucaucgacaugggccacagcgccuaccaggugcuggugugcgccuucaacaagggcaagcugaaggugcuggccaccaccuucgaccccuaccugggcggcagaaacuucgacgaggcccugguggacuacuucugcgacgaguucaagaccaaguacaagaucaacgugaaggagaacagcagagcccugcugagacuguaccaggagugcgagaagcugaagaagcugaugagcgccaacgccagcgaccugccccugaacaucgagugcuucaugaacgaccuggacgugagcagcaagaugaacagagcccaguucgagcagcugugcgccagccugcuggccagaguggagcccccccugaaggccgugauggagcaggccaaccugcagagagaggacaucagcagcaucgagaucgugggcggcgccaccagaauccccgccgugaaggagcagaucaccaaguucuuccugaaggacaucagcaccacccugaacgccgacgaggccguggccagaggcugcgcccugcagugcgccauccugagccccgccuucaaggugagagaguucagcaucaccgaccuggugcccuacagcaucacccugagauggaagaccagcuucgaggacggcagcggcgagugcgagguguucugcaagaaccaccccgcccccuucagcaaggugaucaccuuccacaagaaggagcccuucgagcuggaggccuucuacaccaaccugcacgaggugcccuaccccgacgccagaaucggcagcuucaccauccagaacguguucccccagagcgacggcgacagcagcaaggugaaggugaaggugagagugaacauccacggcaucuucagcguggccagcgccagcgugaucgagaagcagaaccuggagggcgaccacagcgacgcccccauggagaccgagaccagcuucaagaacgagaacaaggacaacauggacaagaugcagguggaccaggaggagggccaccagaagugccacgccgagcacacccccgaggaggagaucgaccacaccggcgccaagaccaagagcgccgugagcgacaagcaggacagacugaaccagacccugaagaagggcaaggugaagagcaucgaccugcccauccagagcagccugugcagacagcugggccaggaccugcugaacagcuacaucgagaacgagggcaagaugaucaugcaggacaagcuggagaaggagagaaacgacgccaagaacgccguggaggaguacguguacgacuucagagacagacugggcaccguguacgagaaguucaucacccccgaggaccugagcaagcugagcgccgugcuggaggacaccgagaacuggcuguacgaggacggcgaggaccagcccaagcagguguacguggacaagcugcaggagcugaagaaguacggccagcccauccagaugaaguacauggagcacgaggagagacccaaggcccugaacgaccugggcaagaagauccagcuggugaugaaggugaucgaggccuacagaaacaaggacgagagauacgaccaccuggaccccaccgagauggagaagguggagaagugcaucagcgacgccaugagcuggcugaacagcaagaugaacgcccagaacaagcugagccugacccaggaccccguggugaaggugagcgagaucguggccaagagcaaggagcuggacaacuucugcaaccccaucaucuacaagcccaagcccaaggccgaggugcccgaggacaagcccaaggccaacagcgagcacaacggccccauggacggccagagcggcaccgagaccaagagcgacagcaccaaggacagcagccagcacaccaagagcagcggcgagauggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6647 - RNA, 2241 nt, Artificial Sequence
  mRNA product Design5 comprising derived and/or modified sequence from Homo sapiens__NP_005338.1__HsHSPA5 (opt4)
gggagagucccgcagucggcguccagcggcucugcuuguucgugugugugucguugcaggccuuauucaagcuuaccaugaagcugagccugguggccgccaugcugcugcugcugagcgccgccagagccgaggaggaggacaagaaggaggacgugggcaccguggugggcaucgaccugggcaccaccuacagcugcgugggcguguucaagaacggcagaguggagaucaucgccaacgaccagggcaacagaaucacccccagcuacguggccuucacccccgagggcgagagacugaucggcgacgccgccaagaaccagcugaccagcaaccccgagaacaccguguucgacgccaagagacugaucggcagaaccuggaacgaccccagcgugcagcaggacaucaaguuccugcccuucaaggugguggagaagaagaccaagcccuacauccagguggacaucggcggcggccagaccaagaccuucgcccccgaggagaucagcgccauggugcugaccaagaugaaggagaccgccgaggccuaccugggcaagaaggugacccacgccguggugaccgugcccgccuacuucaacgacgcccagagacaggccaccaaggacgccggcaccaucgccggccugaacgugaugagaaucaucaacgagcccaccgccgccgccaucgccuacggccuggacaagagagagggcgagaagaacauccugguguucgaccugggcggcggcaccuucgacgugagccugcugaccaucgacaacggcguguucgaggugguggccaccaacggcgacacccaccugggcggcgaggacuucgaccagagagugauggagcacuucaucaagcuguacaagaagaagaccggcaaggacgugagaaaggacaacagagccgugcagaagcugagaagagagguggagaaggccaagagagcccugagcagccagcaccaggccagaaucgagaucgagagcuucuacgagggcgaggacuucagcgagacccugaccagagccaaguucgaggagcugaacauggaccuguucagaagcaccaugaagcccgugcagaaggugcuggaggacagcgaccugaagaagagcgacaucgacgagaucgugcuggugggcggcagcaccagaauccccaagauccagcagcuggugaaggaguucuucaacggcaaggagcccagcagaggcaucaaccccgacgaggccguggccuacggcgccgccgugcaggccggcgugcugagcggcgaccaggacaccggcgaccuggugcugcuggacgugugcccccugacccugggcaucgagaccgugggcggcgugaugaccaagcugauccccagaaacaccguggugcccaccaagaagagccagaucuucagcaccgccagcgacaaccagcccaccgugaccaucaagguguacgagggcgagagaccccugaccaaggacaaccaccugcugggcaccuucgaccugaccggcaucccccccgcccccagaggcgugccccagaucgaggugaccuucgagaucgacgugaacggcauccugagagugaccgccgaggacaagggcaccggcaacaagaacaagaucaccaucaccaacgaccagaacagacugacccccgaggagaucgagagaauggugaacgacgccgagaaguucgccgaggaggacaagaagcugaaggagagaaucgacaccagaaacgagcuggagagcuacgccuacagccugaagaaccagaucggcgacaaggagaagcugggcggcaagcugagcagcgaggacaaggagaccauggagaaggccguggaggagaagaucgaguggcuggagagccaccaggacgccgacaucgaggacuucaaggccaagaagaaggagcuggaggagaucgugcagcccaucaucagcaagcuguacggcagcgccggccccccccccaccggcgaggaggacaccgccgagaaggacgagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6648 - RNA, 2208 nt, Artificial Sequence
  mRNA product Design5 comprising derived and/or modified sequence from Homo sapiens__NP_002146.2__HsHSPA6 (opt4)
gggagagucccgcagucggcguccagcggcucugcuuguucgugugugugucguugcaggccuuauucaagcuuaccaugcaggcccccagagagcuggccgugggcaucgaccugggcaccaccuacagcugcgugggcguguuccagcagggcagaguggagauccuggccaacgaccagggcaacagaaccacccccagcuacguggccuucaccgacaccgagagacuggugggcgacgccgccaagagccaggccgcccugaacccccacaacaccguguucgacgccaagagacugaucggcagaaaguucgccgacaccaccgugcagagcgacaugaagcacuggcccuucagaguggugagcgagggcggcaagcccaaggugagagugugcuacagaggcgaggacaagaccuucuaccccgaggagaucagcagcauggugcugagcaagaugaaggagaccgccgaggccuaccugggccagcccgugaagcacgccgugaucaccgugcccgccuacuucaacgacagccagagacaggccaccaaggacgccggcgccaucgccggccugaacgugcugagaaucaucaacgagcccaccgccgccgccaucgccuacggccuggacagaagaggcgccggcgagagaaacgugcugaucuucgaccugggcggcggcaccuucgacgugagcgugcugagcaucgacgccggcguguucgaggugaaggccaccgccggcgacacccaccugggcggcgaggacuucgacaacagacuggugaaccacuucauggaggaguucagaagaaagcacggcaaggaccugagcggcaacaagagagcccugagaagacugagaaccgccugcgagagagccaagagaacccugagcagcagcacccaggccacccuggagaucgacagccuguucgagggcguggacuucuacaccagcaucaccagagccagauucgaggagcugugcagcgaccuguucagaagcacccuggagcccguggagaaggcccugagagacgccaagcuggacaaggcccagauccacgacguggugcuggugggcggcagcaccagaauccccaaggugcagaagcugcugcaggacuucuucaacggcaaggagcugaacaagagcaucaaccccgacgaggccguggccuacggcgccgccgugcaggccgccgugcugaugggcgacaagugcgagaaggugcaggaccugcugcugcuggacguggccccccugagccugggccuggagaccgccggcggcgugaugaccacccugauccagagaaacgccaccauccccaccaagcagacccagaccuucaccaccuacagcgacaaccagcccggcguguucauccagguguacgagggcgagagagccaugaccaaggacaacaaccugcugggcagauucgagcugagcggcaucccccccgcccccagaggcgugccccagaucgaggugaccuucgacaucgacgccaacggcauccugagcgugaccgccaccgacagaagcaccggcaaggccaacaagaucaccaucaccaacgacaagggcagacugagcaaggaggagguggagagaauggugcacgaggccgagcaguacaaggccgaggacgaggcccagagagacagaguggccgccaagaacagccuggaggcccacguguuccacgugaagggcagccugcaggaggagagccugagagacaagauccccgaggaggacagaagaaagaugcaggacaagugcagagaggugcuggccuggcuggagcacaaccagcuggccgagaaggaggaguacgagcaccagaagagagagcuggagcagaucugcagacccaucuucagcagacuguacggcggccccggcgugcccggcggcagcagcugcggcacccaggccagacagggcgaccccagcaccggccccaucaucgaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6649 - RNA, 1380 nt, Artificial Sequence
  mRNA product Design5 comprising derived and/or modified sequence from Homo sapiens__P48741__HsHSPA7 (opt4)
gggagagucccgcagucggcguccagcggcucugcuuguucgugugugugucguugcaggccuuauucaagcuuaccaugcaggcccccagagagcuggccgugggcaucgaccugggcaccaccuacagcugcgugggcguguuccagcagggcagaguggagauccuggccaacgaccagggcaacagaaccacccccagcuacguggccuucaccgacaccgagagacuggugggcgacgccgccaagagccaggccgcccugaacccccacaacaccguguucgacgccaagagacugaucggcagaaaguucgccgacaccaccgugcagagcgacaugaagcacuggcccuuccagguggugagcgagggcggcaagcccaaggugagagugugcuacagaggcgaggacaagaccuucuaccccgaggagaucagcagcauggugcugagcaagaugaaggagaccgccgaggccuaccugggccagcccgugaagcacgccgugaucaccgugcccaccuacuucagcaacagccagagacaggccaccaaggacgccggcgccaucgccggccugaaggugcugcccaucaucaacgaggccaccgccgccgccaucgccuacggccuggacagaagaggcgccggcaagagaaacgugcugaucuucgaccugggcggcggcaccuucgacgugagcgugcugagcaucgacgccggcguguucgaggugaaggccaccgccggcgacacccaccugggcggcgaggacuucgacaacagacuggugaaccacuucauggaggaguucagaagaaagcacggcaaggaccugagcggcaacaagagagcccugagaagacugagaaccgccugcgagagagccaagagaacccccagcagcagcacccaggccacccuggagaucgacagccuguucgagggcguggacuucuacaagagcaucaccagagccagauucgaggagcugugcagcgaccuguucagaagcacccuggagcccguggagaaggcccugagagacgccaagcuggacaaggcccagauccacgacuucgugcugggcggcggccugcacagccacccccagggcgccgagguggccgccggccugcugcagagacagggcgccgagcaggagcaccagcccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6650 - RNA, 2217 nt, Artificial Sequence
  mRNA product Design5 comprising derived and/or modified sequence from Homo sapiens__NP_006588.1 __HsHSPA8 (opt4)
gggagagucccgcagucggcguccagcggcucugcuuguucgugugugugucguugcaggccuuauucaagcuuaccaugagcaagggccccgccgugggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccguguucgacgccaagagacugaucggcagaagauucgacgacgccguggugcagagcgacaugaagcacuggcccuucaugguggugaacgacgccggcagacccaaggugcagguggaguacaagggcgagaccaagagcuucuaccccgaggaggugagcagcauggugcugaccaagaugaaggagaucgccgaggccuaccugggcaagaccgugaccaacgccguggugaccgugcccgccuacuucaacgacagccagagacaggccaccaaggacgccggcaccaucgccggccugaacgugcugagaaucaucaacgagcccaccgccgccgccaucgccuacggccuggacaagaaggugggcgccgagagaaacgugcugaucuucgaccugggcggcggcaccuucgacgugagcauccugaccaucgaggacggcaucuucgaggugaagagcaccgccggcgacacccaccugggcggcgaggacuucgacaacagaauggugaaccacuucaucgccgaguucaagagaaagcacaagaaggacaucagcgagaacaagagagccgugagaagacugagaaccgccugcgagagagccaagagaacccugagcagcagcacccaggccagcaucgagaucgacagccuguacgagggcaucgacuucuacaccagcaucaccagagccagauucgaggagcugaacgccgaccuguucagaggcacccuggaccccguggagaaggcccugagagacgccaagcuggacaagagccagauccacgacaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugagcggcgacaagagcgagaacgugcaggaccugcugcugcuggacgugaccccccugagccugggcaucgagaccgccggcggcgugaugaccgugcugaucaagagaaacaccaccauccccaccaagcagacccagaccuucaccaccuacagcgacaaccagcccggcgugcugauccagguguacgagggcgagagagccaugaccaaggacaacaaccugcugggcaaguucgagcugaccggcaucccccccgcccccagaggcgugccccagaucgaggugaccuucgacaucgacgccaacggcauccugaacgugagcgccguggacaagagcaccggcaaggagaacaagaucaccaucaccaacgacaagggcagacugagcaaggaggacaucgagagaauggugcaggaggccgagaaguacaaggccgaggacgagaagcagagagacaaggugagcagcaagaacagccuggagagcuacgccuucaacaugaaggccaccguggaggacgagaagcugcagggcaagaucaacgacgaggacaagcagaagauccuggacaagugcaacgagaucaucaacuggcuggacaagaaccagaccgccgagaaggaggaguucgagcaccagcagaaggagcuggagaaggugugcaaccccaucaucaccaagcuguaccagagcgccggcggcaugcccggcggcaugcccggcggcuuccccggcggcggcgccccccccagcggcggcgccagcagcggccccaccaucgaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6651 - RNA, 2316 nt, Artificial Sequence
  mRNA product Design5 comprising derived and/or modified sequence from Homo sapiens__NP_004125.3 __HsHSPA9 (opt4)
gggagagucccgcagucggcguccagcggcucugcuuguucgugugugugucguugcaggccuuauucaagcuuaccaugaucagcgccagcagagccgccgccgccagacuggugggcgccgccgccagcagaggccccaccgccgccagacaccaggacagcuggaacggccugagccacgaggccuucagacuggugagcagaagagacuacgccagcgaggccaucaagggcgccguggugggcaucgaccugggcaccaccaacagcugcguggccgugauggagggcaagcaggccaaggugcuggagaacgccgagggcgccagaaccacccccagcgugguggccuucaccgccgacggcgagagacuggugggcaugcccgccaagagacaggccgugaccaaccccaacaacaccuucuacgccaccaagagacugaucggcagaagauacgacgaccccgaggugcagaaggacaucaagaacgugcccuucaagaucgugagagccagcaacggcgacgccuggguggaggcccacggcaagcuguacagccccagccagaucggcgccuucgugcugaugaagaugaaggagaccgccgagaacuaccugggccacaccgccaagaacgccgugaucaccgugcccgccuacuucaacgacagccagagacaggccaccaaggacgccggccagaucagcggccugaacgugcugagagugaucaacgagcccaccgccgccgcccuggccuacggccuggacaagagcgaggacaaggugaucgccguguacgaccugggcggcggcaccuucgacaucagcauccuggagauccagaagggcguguucgaggugaagagcaccaacggcgacaccuuccugggcggcgaggacuucgaccaggcccugcugagacacaucgugaaggaguucaagagagagaccggcguggaccugaccaaggacaacauggcccugcagagagugagagaggccgccgagaaggccaagugcgagcugagcagcagcgugcagaccgacaucaaccugcccuaccugaccauggacagcagcggccccaagcaccugaacaugaagcugaccagagcccaguucgagggcaucgugaccgaccugaucagaagaaccaucgcccccugccagaaggccaugcaggacgccgaggugagcaagagcgacaucggcgaggugauccuggugggcggcaugaccagaaugcccaaggugcagcagaccgugcaggaccuguucggcagagcccccagcaaggccgugaaccccgacgaggccguggccaucggcgccgccauccagggcggcgugcuggccggcgacgugaccgacgugcugcugcuggacgugaccccccugagccugggcaucgagacccugggcggcguguucaccaagcugaucaacagaaacaccaccauccccaccaagaagagccagguguucagcaccgccgccgacggccagacccagguggagaucaaggugugccagggcgagagagagauggccggcgacaacaagcugcugggccaguucacccugaucggcaucccccccgcccccagaggcgugccccagaucgaggugaccuucgacaucgacgccaacggcaucgugcacgugagcgccaaggacaagggcaccggcagagagcagcagaucgugauccagagcagcggcggccugagcaaggacgacaucgagaacauggugaagaacgccgagaaguacgccgaggaggacagaagaaagaaggagagaguggaggccgugaacauggccgagggcaucauccacgacaccgagaccaagauggaggaguucaaggaccagcugcccgccgacgagugcaacaagcugaaggaggagaucagcaagaugagagagcugcuggccagaaaggacagcgagaccggcgagaacaucagacaggccgccagcagccugcagcaggccagccugaagcuguucgagauggccuacaagaagauggccagcgagagagagggcagcggcagcagcggcaccggcgagcagaaggaggaccagaaggaggagaagcagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6652 - RNA, 2304 nt, Artificial Sequence
  mRNA product Design5 comprising derived and/or modified sequence from Homo sapiens__NP_079291.2__HsHSPA12A (opt4)
gggagagucccgcagucggcguccagcggcucugcuuguucgugugugugucguugcaggccuuauucaagcuuaccauggccgacaaggaggccggcggcagcgacggccccagagagaccgcccccaccagcgccuacagcagccccgccagaagccugggcgacaccggcaucaccccccugagccccagccacaucgugaacgacaccgacagcaacgugagcgagcagcagagcuuccugguggugguggccguggacuucggcaccaccagcagcggcuacgccuacagcuucaccaaggagcccgagugcauccacgugaugagaagaugggagggcggcgaccccggcgugagcaaccagaagacccccaccaccauccugcugacccccgagagaaaguuccacagcuucggcuacgccgccagagacuucuaccacgaccuggaccccaacgaggccaagcaguggcuguaccuggagaaguucaagaugaagcugcacaccaccggcgaccugaccauggacaccgaccugaccgccgccaacggcaagaaggugaaggcccuggagaucuucgccuacgcccugcaguacuucaaggagcaggcccugaaggagcugagcgaccaggccggcagcgaguucgagaacagcgacgugagaugggugaucaccgugcccgccaucuggaagcagcccgccaagcaguucaugagacaggccgccuaccaggccggccuggccagccccgagaacagcgagcagcugaucaucgcccuggagcccgaggccgccagcaucuacugcagaaagcugagacugcaccagaugaucgagcugagcagcaaggccgccgugaacggcuacagcggcagcgacaccgugggcgccggcuucacccaggccaaggagcacaucagaagaaacagacagagcagaaccuuccugguggagaacgugaucggcgagaucuggagcgagcuggaggagggcgacaaguacguggugguggacagcggcggcggcaccguggaccugaccgugcaccagaucagacugcccgagggccaccugaaggagcuguacaaggccaccggcggccccuacggcagccugggcguggacuacgaguucgagaagcugcuguacaagaucuucggcgaggacuucaucgagcaguucaagaucaagagacccgccgccuggguggaccugaugaucgccuucgagagcagaaagagagccgccgcccccgacagaaccaacccccugaacaucacccugcccuucagcuucaucgacuacuacaagaaguucagaggccacagcguggagcacgcccugagaaagagcaacguggacuucgugaaguggagcagccagggcaugcugagaaugagccccgacgccaugaacgcccuguucaagcccaccaucgacagcaucaucgagcaccugagagaccuguuccagaagcccgaggugagcaccgugaaguuccuguuccuggugggcggcuucgccgaggccccccugcugcagcaggccgugcaggccgccuucggcgaccagugcagaaucaucaucccccaggacgugggccugaccauccugaagggcgccgugcuguucggccuggaccccgccgugaucaaggugagaagaagcccccugaccuacggcgugggcgugcugaacagauacguggagggcaagcacccccccgagaagcugcuggugaaggacggcaccagauggugcaccgacguguucgacaaguucaucagcgccgaccagagcguggcccugggcgagcuggugaagagaagcuacacccccgccaagcccagccagcuggugaucgugaucaacaucuacagcagcgagcacgacaacgugagcuucaucaccgaccccggcgugaagaagugcggcacccugagacuggaccugaccggcaccagcggcaccgccgugcccgccagaagagagauccagacccugaugcaguucggcgacaccgagaucaaggccaccgccaucgacaucgccaccagcaagagcgugaaggugggcaucgacuuccugaacuacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6653 - RNA, 2337 nt, Artificial Sequence
  mRNA product Design5 comprising derived and/or modified sequence from Homo sapiens__NP_443202.3 __HsHSPA12B (opt4)
gggagagucccgcagucggcguccagcggcucugcuuguucgugugugugucguugcaggccuuauucaagcuuaccaugcuggccgugcccgagaugggccugcagggccuguacaucggcagcagccccgagagaagccccgugcccagcccccccggcagccccagaacccaggagagcugcggcaucgccccccugacccccagccagagccccaagcccgaggugagagccccccagcaggccagcuucagcguggugguggccaucgacuucggcaccaccagcagcggcuacgccuucagcuucgccagcgaccccgaggccauccacaugaugagaaagugggagggcggcgaccccggcguggcccaccagaagacccccaccugccugcugcugacccccgagggcgccuuccacagcuucggcuacaccgccagagacuacuaccacgaccuggaccccgaggaggccagagacuggcuguacuucgagaaguucaagaugaagauccacagcgccaccgaccugacccugaagacccagcuggaggccgugaacggcaagaccaugcccgcccuggagguguucgcccacgcccugagauucuucagagagcacgcccugcaggagcugagagagcagagccccagccugcccgagaaggacaccgugagaugggugcugaccgugcccgccaucuggaagcagcccgccaagcaguucaugagagaggccgccuaccuggccggccuggugagcagagagaacgccgagcagcugcugaucgcccuggagcccgaggccgccagcguguacugcagaaagcugagacugcaccagcugcuggaccugagcggcagagcccccggcggcggcagacugggcgagagaagaagcaucgacagcagcuucagacaggccagagagcagcugagaagaagcagacacagcagaaccuuccugguggagagcggcgugggcgagcugugggccgagaugcaggccggcgacagauacgugguggccgacugcggcggcggcaccguggaccugaccgugcaccagcuggagcagccccacggcacccugaaggagcuguacaaggccagcggcggccccuacggcgccgugggcguggaccuggccuucgagcagcugcugugcagaaucuucggcgaggacuucaucgccaccuucaagagacagagacccgccgccuggguggaccugaccaucgccuucgaggccagaaagagaaccgccggcccccacagagccggcgcccugaacaucagccugcccuucagcuucaucgacuucuacagaaagcagagaggccacaacguggagaccgcccugagaagaagcagcgugaacuucgugaaguggagcagccagggcaugcugagaaugagcugcgaggccaugaacgagcuguuccagcccaccgugagcggcaucauccagcacaucgaggcccugcuggccagacccgaggugcagggcgugaagcugcuguuccuggugggcggcuucgccgagagcgccgugcugcagcacgccgugcaggccgcccugggcgccagaggccugagagugguggugccccacgacgugggccugaccauccugaagggcgccgugcuguucggccaggcccccggcguggugagagugagaagaagcccccugaccuacggcgugggcgugcugaacagauucgugcccggcagacacccccccgagaagcugcuggugagagacggcagaagauggugcaccgacguguucgagagauucguggccgccgagcagagcguggcccugggcgaggaggugagaagaagcuacugccccgccagacccggccagagaagagugcugaucaaccuguacugcugcgccgccgaggacgccagauucaucaccgaccccggcgugagaaagugcggcgcccugagccuggagcuggagcccgccgacugcggccaggacaccgccggcgccccccccggcagaagagagaucagagccgccaugcaguucggcgacaccgagaucaaggugaccgccguggacgugagcaccaacagaagcgugagagccagcaucgacuuccugagcaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6654 - RNA, 1692 nt, Artificial Sequence
  mRNA product Design5 comprising derived and/or modified sequence from Homo sapiens__NP_008879.3__HsHSPA13 (opt4)
gggagagucccgcagucggcguccagcggcucugcuuguucgugugugugucguugcaggccuuauucaagcuuaccauggccagagagaugaccauccugggcagcgccgugcugacccugcugcuggccggcuaccuggcccagcaguaccugccccugcccacccccaaggugaucggcaucgaccugggcaccaccuacugcagcgugggcguguucuuccccggcaccggcaaggugaaggugauccccgacgagaacggccacaucagcauccccagcauggugagcuucaccgacaacgacguguacgugggcuacgagagcguggagcuggccgacagcaacccccagaacaccaucuacgacgccaagagauucaucggcaagaucuucaccgccgaggagcuggaggccgagaucggcagauaccccuucaaggugcugaacaagaacggcaugguggaguucagcgugaccagcaacgagaccaucaccgugagccccgaguacgugggcagcagacugcugcugaagcugaaggagauggccgaggccuaccugggcaugcccguggccaacgccgugaucagcgugcccgccgaguucgaccugaagcagagaaacagcaccaucgaggccgccaaccuggccggccugaagauccugagagugaucaacgagcccaccgccgccgccauggccuacggccugcacaaggccgacguguuccacgugcuggugaucgaccugggcggcggcacccuggacgugagccugcugaacaagcagggcggcauguuccugaccagagccaugagcggcaacaacaagcugggcggccaggacuucaaccagagacugcugcaguaccuguacaagcagaucuaccagaccuacggcuucgugcccagcagaaaggaggagauccacagacugagacaggccguggagauggugaagcugaaccugacccugcaccagagcgcccagcugagcgugcugcugaccguggaggagcaggacagaaaggagccccacagcagcgacaccgagcugcccaaggacaagcugagcagcgccgacgaccacagagugaacagcggcuucggcagaggccugagcgacaagaagagcggcgagagccaggugcuguucgagaccgagaucagcagaaagcuguucgacacccugaacgaggaccuguuccagaagauccuggugcccauccagcaggugcugaaggagggccaccuggagaagaccgagaucgacgagguggugcuggugggcggcagcaccagaauccccagaaucagacaggugauccaggaguucuucggcaaggaccccaacaccagcguggaccccgaccuggccguggugaccggcguggccauccaggccggcaucgacggcggcagcuggccccugcaggugagcgcccuggagauccccaacaagcaccugcagaagaccaacuucaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6655 - RNA, 1806 nt, Artificial Sequence
  mRNA product Design5 comprising derived and/or modified sequence from Homo sapiens__NP_057383.2__HsHSPA14 (opt4)
gggagagucccgcagucggcguccagcggcucugcuuguucgugugugugucguugcaggccuuauucaagcuuaccauggccgccaucggcgugcaccugggcugcaccagcgccugcguggccguguacaaggacggcagagccggcgugguggccaacgacgccggcgacagagugacccccgccgugguggccuacagcgagaacgaggagaucgugggccuggccgccaagcagagcagaaucagaaacaucagcaacaccgugaugaaggugaagcagauccugggcagaagcagcagcgacccccaggcccagaaguacaucgccgagagcaagugccuggugaucgagaagaacggcaagcugagauacgagaucgacaccggcgaggagaccaaguucgugaaccccgaggacguggccagacugaucuucagcaagaugaaggagaccgcccacagcgugcugggcagcgacgccaacgacguggugaucaccgugcccuucgacuucggcgagaagcagaagaacgcccugggcgaggccgccagagccgccggcuucaacgugcugagacugauccacgagcccagcgccgcccugcuggccuacggcaucggccaggacagccccaccggcaagagcaacauccugguguucaagcugggcggcaccagccugagccugagcgugauggaggugaacagcggcaucuacagagugcugagcaccaacaccgacgacaacaucggcggcgcccacuucaccgagacccuggcccaguaccuggccagcgaguuccagagaagcuucaagcacgacgugagaggcaacgccagagccaugaugaagcugaccaacagcgccgagguggccaagcacagccugagcacccugggcagcgccaacugcuuccuggacagccuguacgagggccaggacuucgacugcaacgugagcagagccagauucgagcugcugugcagcccccuguucaacaagugcaucgaggccaucagaggccugcuggaccagaacggcuucaccgccgacgacaucaacaagguggugcugugcggcggcagcagcagaauccccaagcugcagcagcugaucaaggaccuguuccccgccguggagcugcugaacagcaucccccccgacgaggugauccccaucggcgccgccaucgaggccggcauccugaucggcaaggagaaccugcugguggaggacagccugaugaucgagugcagcgccagagacauccuggugaagggcguggacgagagcggcgccagcagauucaccgugcuguuccccagcggcaccccccugcccgccagaagacagcacacccugcaggcccccggcagcaucagcagcgugugccuggagcuguacgagagcgacggcaagaacagcgccaaggaggagaccaaguucgcccagguggugcugcaggaccuggacaagaaggagaacggccugagagacauccuggccgugcugaccaugaagagagacggcagccugcacgugaccugcaccgaccaggagaccggcaagugcgaggccaucagcaucgagaucgccagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6656 - RNA, 2853 nt, Artificial Sequence
  mRNA product Design5 comprising derived and/or modified sequence from Homo sapiens__NP_006635.2 __HsHSPH1 (opt4)
gggagagucccgcagucggcguccagcggcucugcuuguucgugugugugucguugcaggccuuauucaagcuuaccaugagcguggugggccuggacgugggcagccagagcugcuacaucgccguggccagagccggcggcaucgagaccaucgccaacgaguucagcgacagaugcacccccagcgugaucagcuucggcagcaagaacagaaccaucggcguggccgccaagaaccagcagaucacccacgccaacaacaccgugagcaacuucaagagauuccacggcagagccuucaacgaccccuucauccagaaggagaaggagaaccugagcuacgaccuggugccccugaagaacggcggcgugggcaucaaggugauguacaugggcgaggagcaccuguucagcguggagcagaucaccgccaugcugcugaccaagcugaaggagaccgccgagaacagccugaagaagcccgugaccgacugcgugaucagcgugcccagcuucuucaccgacgccgagagaagaagcgugcuggacgccgcccagaucgugggccugaacugccugagacugaugaacgacaugaccgccguggcccugaacuacggcaucuacaagcaggaccugcccagccuggacgagaagcccagaaucgugguguucguggacaugggccacagcgccuuccaggugagcgccugcgccuucaacaagggcaagcugaaggugcugggcaccgccuucgaccccuuccugggcggcaagaacuucgacgagaagcugguggagcacuucugcgccgaguucaagaccaaguacaagcuggacgccaagagcaagaucagagcccugcugagacuguaccaggagugcgagaagcugaagaagcugaugagcagcaacagcaccgaccugccccugaacaucgagugcuucaugaacgacaaggacgugagcggcaagaugaacagaagccaguucgaggagcugugcgccgagcugcugcagaagaucgaggugccccuguacagccugcuggagcagacccaccugaagguggaggacgugagcgccguggagaucgugggcggcgccaccagaauccccgccgugaaggagagaaucgccaaguucuucggcaaggacaucagcaccacccugaacgccgacgaggccguggccagaggcugcgcccugcagugcgccauccugagccccgccuucaaggugagagaguucagcgugaccgacgccgugcccuuccccaucagccugaucuggaaccacgacagcgaggacaccgagggcgugcacgagguguucagcagaaaccacgccgcccccuucagcaaggugcugaccuuccugagaagaggccccuucgagcuggaggccuucuacagcgacccccagggcgugcccuaccccgaggccaagaucggcagauucguggugcagaacgugagcgcccagaaggacggcgagaagagcagagugaaggugaaggugagagugaacacccacggcaucuucaccaucagcaccgccagcaugguggagaaggugcccaccgaggagaacgagaugagcagcgaggccgacauggagugccugaaccagagaccccccgagaaccccgacaccgacaagaacgugcagcaggacaacagcgaggccggcacccagccccaggugcagaccgacgcccagcagaccagccagagcccccccagccccgagcugaccagcgaggagaacaagauccccgacgccgacaaggccaacgagaagaagguggaccagccccccgaggccaagaagcccaagaucaagguggugaacguggagcugcccaucgaggccaaccugguguggcagcugggcaaggaccugcugaacauguacaucgagaccgagggcaagaugaucaugcaggacaagcuggagaaggagagaaacgacgccaagaacgccguggaggaguacguguacgaguucagagacaagcugugcggccccuacgagaaguucaucugcgagcaggaccaccagaacuuccugagacugcugaccgagaccgaggacuggcuguacgaggagggcgaggaccaggccaagcaggccuacguggacaagcuggaggagcugaugaagaucggcacccccgugaaggugagauuccaggaggccgaggagagacccaagauguucgaggagcugggccagagacugcagcacuacgccaagaucgccgccgacuucagaaacaaggacgagaaguacaaccacaucgacgagagcgagaugaagaagguggagaagagcgugaacgaggugauggaguggaugaacaacgugaugaacgcccaggccaagaagagccuggaccaggaccccguggugagagcccaggagaucaagaccaagaucaaggagcugaacaacaccugcgagcccguggugacccagcccaagcccaagaucgagagccccaagcuggagagaacccccaacggccccaacaucgacaagaaggaggaggaccuggaggacaagaacaacuucggcgccgagcccccccaccagaacggcgagugcuaccccaacgagaagaacagcgugaacauggaccuggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6657 - RNA, 3276 nt, Artificial Sequence
  mRNA product Design5 comprising derived and/or modified sequence from Homo sapiens__NP_006380.1 __HsHYOU1 (opt4)
gggagagucccgcagucggcguccagcggcucugcuuguucgugugugugucguugcaggccuuauucaagcuuaccauggccgacaaggugagaagacagagacccagaagaagagugugcugggcccugguggccgugcugcuggccgaccugcuggcccugagcgacacccuggccgugaugagcguggaccugggcagcgagagcaugaagguggccaucgugaagcccggcgugcccauggagaucgugcugaacaaggagagcagaagaaagacccccgugaucgugacccugaaggagaacgagagauucuucggcgacagcgccgccagcauggccaucaagaaccccaaggccacccugagauacuuccagcaccugcugggcaagcaggccgacaacccccacguggcccuguaccaggccagauuccccgagcacgagcugaccuucgacccccagagacagaccgugcacuuccagaucagcagccagcugcaguucagccccgaggaggugcugggcauggugcugaacuacagcagaagccuggccgaggacuucgccgagcagcccaucaaggacgccgugaucaccgugcccguguucuucaaccaggccgagagaagagccgugcugcaggccgccagaauggccggccugaaggugcugcagcugaucaacgacaacaccgccaccgcccugagcuacggcguguucagaagaaaggacaucaacaccaccgcccagaacaucauguucuacgacaugggcagcggcagcaccgugugcaccaucgugaccuaccagauggugaagaccaaggaggccggcaugcagccccagcugcagaucagaggcgugggcuucgacagaacccugggcggccuggagauggagcugagacugagagagagacuggccggccuguucaacgagcagagaaagggccagagagccaaggacgugagagagaaccccagagccauggccaagcugcugagagaggccaacagacugaagaccgugcugagcgccaacgccgaccacauggcccagaucgagggccugauggacgacguggacuucaaggccaaggugaccagaguggaguucgaggagcugugcgccgaccuguucgagagagugcccggccccgugcagcaggcccugcagagcgccgagaugagccuggacgagaucgagcaggugauccuggugggcggcgccaccagagugcccagagugcaggaggugcugcugaaggccgugggcaaggaggagcugggcaagaacaucaacgccgacgaggccgccgccaugggcgccguguaccaggccgccgcccugagcaaggccuucaaggugaagcccuucguggugagagacgccgugguguaccccauccugguggaguucaccagagagguggaggaggagcccggcauccacagccugaagcacaacaagagagugcuguucagcagaaugggccccuacccccagagaaaggugaucaccuucaacagauacagccacgacuucaacuuccacaucaacuacggcgaccugggcuuccugggccccgaggaccugagaguguucggcagccagaaccugaccaccgugaagcugaagggcgugggcgacagcuucaagaaguaccccgacuacgagagcaagggcaucaaggcccacuucaaccuggacgagagcggcgugcugagccuggacagaguggagagcguguucgagacccugguggaggacagcgccgaggaggagagcacccugaccaagcugggcaacaccaucagcagccuguucggcggcggcaccacccccgacgccaaggagaacggcaccgacaccgugcaggaggaggaggagagccccgccgagggcagcaaggacgagcccggcgagcagguggagcugaaggaggaggccgaggcccccguggaggacggcagccagccccccccccccgagcccaagggcgacgccacccccgagggcgagaaggccaccgagaaggagaacggcgacaagagcgaggcccagaagcccagcgagaaggccgaggccggccccgagggcguggcccccgcccccgagggcgagaagaagcagaagcccgccagaaagagaagaaugguggaggagaucggcguggagcugguggugcuggaccugcccgaccugcccgaggacaagcuggcccagagcgugcagaagcugcaggaccugacccugagagaccuggagaagcaggagagagagaaggccgccaacagccuggaggccuucaucuucgagacccaggacaagcuguaccagcccgaguaccaggaggugagcaccgaggagcagagagaggagaucagcggcaagcugagcgccgccagcaccuggcuggaggacgagggcgugggcgccaccaccgugaugcugaaggagaagcuggccgagcugagaaagcugugccagggccuguucuucagaguggaggagagaaagaaguggcccgagagacugagcgcccuggacaaccugcugaaccacagcagcauguuccugaagggcgccagacugauccccgagauggaccagaucuucaccgagguggagaugaccacccuggagaaggugaucaacgagaccugggccuggaagaacgccacccuggccgagcaggccaagcugcccgccaccgagaagcccgugcugcugagcaaggacaucgaggccaagaugauggcccuggacagagaggugcaguaccugcugaacaaggccaaguucaccaagcccagacccagacccaaggacaagaacggcaccagagccgagcccccccugaacgccagcgccagcgaccagggcgagaaggugaucccccccgccggccagaccgaggacgccgagcccaucagcgagcccgagaagguggagaccggcagcgagcccggcgacaccgagccccuggagcugggcggccccggcgccgagcccgagcagaaggagcagagcaccggccagaagagaccccugaagaacgacgagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6658 - RNA, 2475 nt, Artificial Sequence
  mRNA product Design5 comprising derived and/or modified sequence from Homo sapiens__NP_005339.3 __HsHSP90AA1 (opt4)
gggagagucccgcagucggcguccagcggcucugcuuguucgugugugugucguugcaggccuuauucaagcuuaccaugcccgaggagacccagacccaggaccagcccauggaggaggaggagguggagaccuucgccuuccaggccgagaucgcccagcugaugagccugaucaucaacaccuucuacagcaacaaggagaucuuccugagagagcugaucagcaacagcagcgacgcccuggacaagaucagauacgagagccugaccgaccccagcaagcuggacagcggcaaggagcugcacaucaaccugauccccaacaagcaggacagaacccugaccaucguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugaccgugaucaccaagcacaacgacgacgagcaguacgccugggagagcagcgccggcggcagcuucaccgugagaaccgacaccggcgagcccaugggcagaggcaccaaggugauccugcaccugaaggaggaccagaccgaguaccuggaggagagaagaaucaaggagaucgugaagaagcacagccaguucaucggcuaccccaucacccuguucguggagaaggagagagacaaggaggugagcgacgacgaggccgaggagaaggaggacaaggaggaggagaaggagaaggaggagaaggagagcgaggacaagcccgagaucgaggacgugggcagcgacgaggaggaggagaagaaggacggcgacaagaagaagaagaagaagaucaaggagaaguacaucgaccaggaggagcugaacaagaccaagcccaucuggaccagaaaccccgacgacaucaccaacgaggaguacggcgaguucuacaagagccugaccaacgacugggaggaccaccuggccgugaagcacuucagcguggagggccagcuggaguucagagcccugcuguucgugcccagaagagcccccuucgaccuguucgagaacagaaagaagaagaacaacaucaagcuguacgugagaagaguguucaucauggacaacugcgaggagcugauccccgaguaccugaacuucaucagaggcgugguggacagcgaggaccugccccugaacaucagcagagagaugcugcagcagagcaagauccugaaggugaucagaaagaaccuggugaagaagugccuggagcuguucaccgagcuggccgaggacaaggagaacuacaagaaguucuacgagcaguucagcaagaacaucaagcugggcauccacgaggacagccagaacagaaagaagcugagcgagcugcugagauacuacaccagcgccagcggcgacgagauggugagccugaaggacuacugcaccagaaugaaggagaaccagaagcacaucuacuacaucaccggcgagaccaaggaccagguggccaacagcgccuucguggagagacugagaaagcacggccuggaggugaucuacaugaucgagcccaucgacgaguacugcgugcagcagcugaaggaguucgagggcaagacccuggugagcgugaccaaggagggccuggagcugcccgaggacgaggaggagaagaagaagcaggaggagaagaagaccaaguucgagaaccugugcaagaucaugaaggacauccuggagaagaagguggagaaggugguggugagcaacagacuggugaccagccccugcugcaucgugaccagcaccuacggcuggaccgccaacauggagagaaucaugaaggcccaggcccugagagacaacagcaccaugggcuacauggccgccaagaagcaccuggagaucaaccccgaccacagcaucaucgagacccugagacagaaggccgaggccgacaagaacgacaagagcgugaaggaccuggugauccugcuguacgagaccgcccugcugagcagcggcuucagccuggaggacccccagacccacgccaacagaaucuacagaaugaucaagcugggccugggcaucgacgaggacgaccccaccgccgacgacaccagcgccgccgugaccgaggagaugcccccccuggagggcgacgacgacaccagcagaauggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6659 - RNA, 615 nt, Artificial Sequence
  mRNA product Design5 comprising derived and/or modified sequence from Homo sapiens__NG_005218__HsHSP90AA3P (opt4)
gggagagucccgcagucggcguccagcggcucugcuuguucgugugugugucguugcaggccuuauucaagcuuaccauggacagcagcaagcuggacagcggcaagggccugcacaucaaccuggugcccaacaagcagaaccagacccugaccaucguggacaccagaaucggcaugaccaagaccgaccugaucaacaaccugggcaccgugaccaagagcggcaccaaggccuucauggaggcccugcaggccgacgccgacaucagcaugaucggccacuucggcgugggcuucuacagcgccuaccugguggccaagaaggugaccgugaucagcaagcacaacaacgacgagcaguacaccugggagagcagcgccggcggcagcuucaccgugagaaccgacgagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6660 - RNA, 2451 nt, Artificial Sequence
  mRNA product Design5 comprising derived and/or modified sequence from Homo sapiens__NP_031381.2__HsHSP90AB1 (opt4)
gggagagucccgcagucggcguccagcggcucugcuuguucgugugugugucguugcaggccuuauucaagcuuaccaugcccgaggaggugcaccacggcgaggaggagguggagaccuucgccuuccaggccgagaucgcccagcugaugagccugaucaucaacaccuucuacagcaacaaggagaucuuccugagagagcugaucagcaacgccagcgacgcccuggacaagaucagauacgagagccugaccgaccccagcaagcuggacagcggcaaggagcugaagaucgacaucauccccaacccccaggagagaacccugacccugguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugguggugaucaccaagcacaacgacgacgagcaguacgccugggagagcagcgccggcggcagcuucaccgugagagccgaccacggcgagcccaucggcagaggcaccaaggugauccugcaccugaaggaggaccagaccgaguaccuggaggagagaagagugaaggagguggugaagaagcacagccaguucaucggcuaccccaucacccuguaccuggagaaggagagagagaaggagaucagcgacgacgaggccgaggaggagaagggcgagaaggaggaggaggacaaggacgacgaggagaagcccaagaucgaggacgugggcagcgacgaggaggacgacagcggcaaggacaagaagaagaagaccaagaagaucaaggagaaguacaucgaccaggaggagcugaacaagaccaagcccaucuggaccagaaaccccgacgacaucacccaggaggaguacggcgaguucuacaagagccugaccaacgacugggaggaccaccuggccgugaagcacuucagcguggagggccagcuggaguucagagcccugcuguucauccccagaagagcccccuucgaccuguucgagaacaagaagaagaagaacaacaucaagcuguacgugagaagaguguucaucauggacagcugcgacgagcugauccccgaguaccugaacuucaucagaggcgugguggacagcgaggaccugccccugaacaucagcagagagaugcugcagcagagcaagauccugaaggugaucagaaagaacaucgugaagaagugccuggagcuguucagcgagcuggccgaggacaaggagaacuacaagaaguucuacgaggccuucagcaagaaccugaagcugggcauccacgaggacagcaccaacagaagaagacugagcgagcugcugagauaccacaccagccagagcggcgacgagaugaccagccugagcgaguacgugagcagaaugaaggagacccagaagagcaucuacuacaucaccggcgagagcaaggagcagguggccaacagcgccuucguggagagagugagaaagagaggcuucgaggugguguacaugaccgagcccaucgacgaguacugcgugcagcagcugaaggaguucgacggcaagagccuggugagcgugaccaaggagggccuggagcugcccgaggacgaggaggagaagaagaagauggaggagagcaaggccaaguucgagaaccugugcaagcugaugaaggagauccuggacaagaagguggagaaggugaccaucagcaacagacuggugagcagccccugcugcaucgugaccagcaccuacggcuggaccgccaacauggagagaaucaugaaggcccaggcccugagagacaacagcaccaugggcuacaugauggccaagaagcaccuggagaucaaccccgaccaccccaucguggagacccugagacagaaggccgaggccgacaagaacgacaaggccgugaaggaccugguggugcugcuguucgagaccgcccugcugagcagcggcuucagccuggaggacccccagacccacagcaacagaaucuacagaaugaucaagcugggccugggcaucgacgaggacgagguggccgccgaggagcccaacgccgccgugcccgacgagauccccccccuggagggcgacgaggacgccagcagaauggaggagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6661 - RNA, 2688 nt, Artificial Sequence
  mRNA product Design5 comprising derived and/or modified sequence from Homo sapiens__NP_003290.1__HsHSP90B1 (opt4)
gggagagucccgcagucggcguccagcggcucugcuuguucgugugugugucguugcaggccuuauucaagcuuaccaugagagcccugugggugcugggccugugcugcgugcugcugaccuucggcagcgugagagccgacgacgagguggacguggacggcaccguggaggaggaccugggcaagagcagagagggcagcagaaccgacgacgagguggugcagagagaggaggaggccauccagcuggacggccugaacgccagccagaucagagagcugagagagaagagcgagaaguucgccuuccaggccgaggugaacagaaugaugaagcugaucaucaacagccuguacaagaacaaggagaucuuccugagagagcugaucagcaacgccagcgacgcccuggacaagaucagacugaucagccugaccgacgagaacgcccugagcggcaacgaggagcugaccgugaagaucaagugcgacaaggagaagaaccugcugcacgugaccgacaccggcgugggcaugaccagagaggagcuggugaagaaccugggcaccaucgccaagagcggcaccagcgaguuccugaacaagaugaccgaggcccaggaggacggccagagcaccagcgagcugaucggccaguucggcgugggcuucuacagcgccuuccugguggccgacaaggugaucgugaccagcaagcacaacaacgacacccagcacaucugggagagcgacagcaacgaguucagcgugaucgccgaccccagaggcaacacccugggcagaggcaccaccaucacccuggugcugaaggaggaggccagcgacuaccuggagcuggacaccaucaagaaccuggugaagaaguacagccaguucaucaacuuccccaucuacguguggagcagcaagaccgagaccguggaggagcccauggaggaggaggaggccgccaaggaggagaaggaggagagcgacgacgaggccgccguggaggaggaggaggaggagaagaagcccaagaccaagaagguggagaagaccgugugggacugggagcugaugaacgacaucaagcccaucuggcagagacccagcaaggagguggaggaggacgaguacaaggccuucuacaagagcuucagcaaggagagcgacgaccccauggccuacauccacuucaccgccgagggcgaggugaccuucaagagcauccuguucgugcccaccagcgcccccagaggccuguucgacgaguacggcagcaagaagagcgacuacaucaagcuguacgugagaagaguguucaucaccgacgacuuccacgacaugaugcccaaguaccugaacuucgugaagggcgugguggacagcgacgaccugccccugaacgugagcagagagacccugcagcagcacaagcugcugaaggugaucagaaagaagcuggugagaaagacccuggacaugaucaagaagaucgccgacgacaaguacaacgacaccuucuggaaggaguucggcaccaacaucaagcugggcgugaucgaggaccacagcaacagaaccagacuggccaagcugcugagauuccagagcagccaccaccccaccgacaucaccagccuggaccaguacguggagagaaugaaggagaagcaggacaagaucuacuucauggccggcagcagcagaaaggaggccgagagcagccccuucguggagagacugcugaagaagggcuacgaggugaucuaccugaccgagcccguggacgaguacugcauccaggcccugcccgaguucgacggcaagagauuccagaacguggccaaggagggcgugaaguucgacgagagcgagaagaccaaggagagcagagaggccguggagaaggaguucgagccccugcugaacuggaugaaggacaaggcccugaaggacaagaucgagaaggccguggugagccagagacugaccgagagccccugcgcccugguggccagccaguacggcuggagcggcaacauggagagaaucaugaaggcccaggccuaccagaccggcaaggacaucagcaccaacuacuacgccagccagaagaagaccuucgagaucaaccccagacacccccugaucagagacaugcugagaagaaucaaggaggacgaggacgacaagaccgugcuggaccuggccguggugcuguucgagaccgccacccugagaagcggcuaccugcugcccgacaccaaggccuacggcgacagaaucgagagaaugcugagacugagccugaacaucgaccccgacgccaagguggaggaggagcccgaggaggagcccgaggagaccgccgaggacaccaccgaggacaccgagcaggacgaggacgaggagauggacgugggcaccgacgaggaggaggagaccgccaaggagagcaccgccgagaaggacgagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6662 - RNA, 2391 nt, Artificial Sequence
  mRNA product Design5 comprising derived and/or modified sequence from Homo sapiens__NP_057376.2__HsTRAP1 (opt4)
gggagagucccgcagucggcguccagcggcucugcuuguucgugugugugucguugcaggccuuauucaagcuuaccauggccagagagcugagagcccugcugcuguggggcagaagacugagaccccugcugagagcccccgcccuggccgccgugcccggcggcaagcccauccugugccccagaagaaccaccgcccagcugggccccagaagaaaccccgccuggagccugcaggccggcagacuguucagcacccagaccgccgaggacaaggaggagccccugcacagcaucaucagcagcaccgagagcgugcagggcagcaccagcaagcacgaguuccaggccgagaccaagaagcugcuggacaucguggccagaagccuguacagcgagaaggagguguucaucagagagcugaucagcaacgccagcgacgcccuggagaagcugagacacaagcuggugagcgacggccaggcccugcccgagauggagauccaccugcagaccaacgccgagaagggcaccaucaccauccaggacaccggcaucggcaugacccaggaggagcuggugagcaaccugggcaccaucgccagaagcggcagcaaggccuuccuggacgcccugcagaaccaggccgaggccagcagcaagaucaucggccaguucggcgugggcuucuacagcgccuucaugguggccgacagaguggagguguacagcagaagcgccgcccccggcagccugggcuaccaguggcugagcgacggcagcggcguguucgagaucgccgaggccagcggcgugagaaccggcaccaagaucaucauccaccugaagagcgacugcaaggaguucagcagcgaggccagagugagagacguggugaccaaguacagcaacuucgugagcuucccccuguaccugaacggcagaagaaugaacacccugcaggccaucuggaugauggaccccaaggacgugagagaguggcagcacgaggaguucuacagauacguggcccaggcccacgacaagcccagauacacccugcacuacaagaccgacgccccccugaacaucagaagcaucuucuacgugcccgacaugaagcccagcauguucgacgugagcagagagcugggcagcagcguggcccuguacagcagaaaggugcugauccagaccaaggccaccgacauccugcccaaguggcugagauucaucagaggcgugguggacagcgaggacaucccccugaaccugagcagagagcugcugcaggagagcgcccugaucagaaagcugagagacgugcugcagcagagacugaucaaguucuucaucgaccagagcaagaaggacgccgagaaguacgccaaguucuucgaggacuacggccuguucaugagagagggcaucgugaccgccaccgagcaggaggugaaggaggacaucgccaagcugcugagauacgagagcagcgcccugcccagcggccagcugaccagccugagcgaguacgccagcagaaugagagccggcaccagaaacaucuacuaccugugcgcccccaacagacaccuggccgagcacagccccuacuacgaggccaugaagaagaaggacaccgaggugcuguucugcuucgagcaguucgacgagcugacccugcugcaccugagagaguucgacaagaagaagcugaucagcguggagaccgacaucgugguggaccacuacaaggaggagaaguucgaggacagaagccccgccgccgagugccugagcgagaaggagaccgaggagcugauggccuggaugagaaacgugcugggcagcagagugaccaacgugaaggugacccugagacuggacacccaccccgccauggugaccgugcuggagaugggcgccgccagacacuuccugagaaugcagcagcuggccaagacccaggaggagagagcccagcugcugcagcccacccuggagaucaaccccagacacgcccugaucaagaagcugaaccagcugagagccagcgagcccggccuggcccagcugcugguggaccagaucuacgagaacgccaugaucgccgccggccugguggacgaccccagagccauggugggcagacugaacgagcugcuggugaaggcccuggagagacacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6663 - RNA, 738 nt, Artificial Sequence
  mRNA product Design5 comprising derived and/or modified sequence from Homo sapiens__NP_000609.1__HsIGF1 (opt4)
gggagagucccgcagucggcguccagcggcucugcuuguucgugugugugucguugcaggccuuauucaagcuuaccaugggcaagaucagcagccugcccacccagcuguucaagugcugcuucugcgacuuccugaaggugaagaugcacaccaugagcagcagccaccuguucuaccuggcccugugccugcugaccuucaccagcagcgccaccgccggccccgagacccugugcggcgccgagcugguggacgcccugcaguucgugugcggcgacagaggcuucuacuucaacaagcccaccggcuacggcagcagcagcagaagagccccccagaccggcaucguggacgagugcugcuucagaagcugcgaccugagaagacuggagauguacugcgccccccugaagcccgccaagagcgccagaagcgugagagcccagagacacaccgacaugcccaagacccagaaggaggugcaccugaagaacgccagcagaggcagcgccggcaacaagaacuacagaaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6664 - RNA, 819 nt, Artificial Sequence
  mRNA product Design5 comprising derived and/or modified sequence from Homo sapiens__NP_000603.1__HsIGF2 (opt4)
gggagagucccgcagucggcguccagcggcucugcuuguucgugugugugucguugcaggccuuauucaagcuuaccaugggcauccccaugggcaagagcaugcuggugcugcugaccuuccuggccuucgccagcugcugcaucgccgccuacagacccagcgagacccugugcggcggcgagcugguggacacccugcaguucgugugcggcgacagaggcuucuacuucagcagacccgccagcagagugagcagaagaagcagaggcaucguggaggagugcugcuucagaagcugcgaccuggcccugcuggagaccuacugcgccacccccgccaagagcgagagagacgugagcaccccccccaccgugcugcccgacaacuuccccagauaccccgugggcaaguucuuccaguacgacaccuggaagcagagcacccagagacugagaagaggccugcccgcccugcugagagccagaagaggccacgugcuggccaaggagcuggaggccuucagagaggccaagagacacagaccccugaucgcccugcccacccaggaccccgcccacggcggcgccccccccgagauggccagcaacagaaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6665 - RNA, 915 nt, Artificial Sequence
  mRNA product Design5 comprising derived and/or modified sequence from Homo sapiens__NP_000591.1__HsIL6 (opt4)
gggagagucccgcagucggcguccagcggcucugcuuguucgugugugugucguugcaggccuuauucaagcuuaccaugaacagcuucagcaccagcgccuucggccccguggccuucagccugggccugcugcuggugcugcccgccgccuuccccgcccccgugccccccggcgaggacagcaaggacguggccgccccccacagacagccccugaccagcagcgagagaaucgacaagcagaucagauacauccuggacggcaucagcgcccugagaaaggagaccugcaacaagagcaacaugugcgagagcagcaaggaggcccuggccgagaacaaccugaaccugcccaagauggccgagaaggacggcugcuuccagagcggcuucaacgaggagaccugccuggugaagaucaucaccggccugcuggaguucgagguguaccuggaguaccugcagaacagauucgagagcagcgaggagcaggccagagccgugcagaugagcaccaaggugcugauccaguuccugcagaagaaggccaagaaccuggacgccaucaccacccccgaccccaccaccaacgccagccugcugaccaagcugcaggcccagaaccaguggcugcaggacaugaccacccaccugauccugagaagcuucaaggaguuccugcagagcagccugagagcccugagacagaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6666 - RNA, 1557 nt, Artificial Sequence
  mRNA product Design5 comprising derived and/or modified sequence from Homo sapiens__NP_002183.1__HsINHBA (opt4)
gggagagucccgcagucggcguccagcggcucugcuuguucgugugugugucguugcaggccuuauucaagcuuaccaugccccugcuguggcugagaggcuuccugcuggccagcugcuggaucaucgugagaagcagccccacccccggcagcgagggccacagcgccgcccccgacugccccagcugcgcccuggccgcccugcccaaggacgugcccaacagccagcccgagaugguggaggccgugaagaagcacauccugaacaugcugcaccugaagaagagacccgacgugacccagcccgugcccaaggccgcccugcugaacgccaucagaaagcugcacgugggcaaggugggcgagaacggcuacguggagaucgaggacgacaucggcagaagagccgagaugaacgagcugauggagcagaccagcgagaucaucaccuucgccgagagcggcaccgccagaaagacccugcacuucgagaucagcaaggagggcagcgaccugagcgugguggagagagccgagguguggcuguuccugaaggugcccaaggccaacagaaccagaaccaaggugaccaucagacuguuccagcagcagaagcacccccagggcagccuggacaccggcgaggaggccgaggaggugggccugaagggcgagagaagcgagcugcugcugagcgagaaggugguggacgccagaaagagcaccuggcacguguuccccgugagcagcagcauccagagacugcuggaccagggcaagagcagccuggacgugagaaucgccugcgagcagugccaggagagcggcgccagccuggugcugcugggcaagaagaagaagaaggaggaggagggcgagggcaagaagaagggcggcggcgagggcggcgccggcgccgacgaggagaaggagcagagccacagacccuuccugaugcugcaggccagacagagcgaggaccacccccacagaagaagaagaagaggccuggagugcgacggcaaggugaacaucugcugcaagaagcaguucuucgugagcuucaaggacaucggcuggaacgacuggaucaucgcccccagcggcuaccacgccaacuacugcgagggcgagugccccagccacaucgccggcaccagcggcagcagccugagcuuccacagcaccgugaucaaccacuacagaaugagaggccacagccccuucgccaaccugaagagcugcugcgugcccaccaagcugagacccaugagcaugcuguacuacgacgacggccagaacaucaucaagaaggacauccagaacaugaucguggaggagugcggcugcagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6667 - RNA, 1500 nt, Artificial Sequence
  mRNA product Design5 comprising derived and/or modified sequence from Homo sapiens__NP_002184.2__HsINHBB (opt4)
gggagagucccgcagucggcguccagcggcucugcuuguucgugugugugucguugcaggccuuauucaagcuuaccauggacggccugcccggcagagcccugggcgccgccugccugcugcugcuggccgccggcuggcugggccccgaggccuggggcagccccacccccccccccacccccgccgcccccccccccccccccccccccggcagccccggcggcagccaggacaccugcaccagcugcggcggcuucagaagacccgaggagcugggcagaguggacggcgacuuccuggaggccgugaagagacacauccugagcagacugcagaugagaggcagacccaacaucacccacgccgugcccaaggccgccauggugaccgcccugagaaagcugcacgccggcaaggugagagaggacggcagaguggagaucccccaccuggacggccacgccagccccggcgccgacggccaggagagagugagcgagaucaucagcuucgccgagaccgacggccuggccagcagcagagugagacuguacuucuucaucagcaacgagggcaaccagaaccuguucguggugcaggccagccuguggcuguaccugaagcugcugcccuacgugcuggagaagggcagcagaagaaaggugagagugaagguguacuuccaggagcagggccacggcgacagauggaacaugguggagaagagaguggaccugaagagaagcggcuggcacaccuucccccugaccgaggccauccaggcccuguucgagagaggcgagagaagacugaaccuggacgugcagugcgacagcugccaggagcuggccguggugcccguguucguggaccccggcgaggagagccacagacccuucgugguggugcaggccagacugggcgacagcagacacagaaucagaaagagaggccuggagugcgacggcagaaccaaccugugcugcagacagcaguucuucaucgacuucagacugaucggcuggaacgacuggaucaucgcccccaccggcuacuacggcaacuacugcgagggcagcugccccgccuaccuggccggcgugcccggcagcgccagcagcuuccacaccgccguggugaaccaguacagaaugagaggccugaaccccggcaccgugaacagcugcugcauccccaccaagcugagcaccaugagcaugcuguacuucgacgacgaguacaacaucgugaagagagacgugcccaacaugaucguggaggagugcggcugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6668 - RNA, 3735 nt, Artificial Sequence
  mRNA product Design5 comprising derived and/or modified sequence from Homo sapiens__NP_000623.2__HsITGAM (opt4)
gggagagucccgcagucggcguccagcggcucugcuuguucgugugugugucguugcaggccuuauucaagcuuaccauggcccugagagugcugcugcugaccgcccugacccugugccacggcuucaaccuggacaccgagaacgccaugaccuuccaggagaacgccagaggcuucggccagagcguggugcagcugcagggcagcagagugguggugggcgccccccaggagaucguggccgccaaccagagaggcagccuguaccagugcgacuacagcaccggcagcugcgagcccaucagacugcaggugcccguggaggccgugaacaugagccugggccugagccuggccgccaccaccagccccccccagcugcuggccugcggccccaccgugcaccagaccugcagcgagaacaccuacgugaagggccugugcuuccuguucggcagcaaccugagacagcagccccagaaguuccccgaggcccugagaggcugcccccaggaggacagcgacaucgccuuccugaucgacggcagcggcagcaucaucccccacgacuucagaagaaugaaggaguucgugagcaccgugauggagcagcugaagaagagcaagacccuguucagccugaugcaguacagcgaggaguucagaauccacuucaccuucaaggaguuccagaacaaccccaaccccagaagccuggugaagcccaucacccagcugcugggcagaacccacaccgccaccggcaucagaaagguggugagagagcuguucaacaucaccaacggcgccagaaagaacgccuucaagauccugguggugaucaccgacggcgagaaguucggcgacccccugggcuacgaggacgugauccccgaggccgacagagagggcgugaucagauacgugaucggcgugggcgacgccuucagaagcgagaagagcagacaggagcugaacaccaucgccagcaagccccccagagaccacguguuccaggugaacaacuucgaggcccugaagaccauccagaaccagcugagagagaagaucuucgccaucgagggcacccagaccggcagcagcagcagcuucgagcacgagaugagccaggagggcuucagcgccgccaucaccagcaacggcccccugcugagcaccgugggcagcuacgacugggccggcggcguguuccuguacaccagcaaggagaagagcaccuucaucaacaugaccagaguggacagcgacaugaacgacgccuaccugggcuacgccgccgccaucauccugagaaacagagugcagagccuggugcugggcgcccccagauaccagcacaucggccugguggccauguucagacagaacaccggcaugugggagagcaacgccaacgugaagggcacccagaucggcgccuacuucggcgccagccugugcagcguggacguggacagcaacggcagcaccgaccuggugcugaucggcgccccccacuacuacgagcagaccagaggcggccaggugagcgugugcccccugcccagaggcagagccagauggcagugcgacgccgugcuguacggcgagcagggccagcccuggggcagauucggcgccgcccugaccgugcugggcgacgugaacggcgacaagcugaccgacguggccaucggcgcccccggcgaggaggacaacagaggcgccguguaccuguuccacggcaccagcggcagcggcaucagccccagccacagccagagaaucgccggcagcaagcugagccccagacugcaguacuucggccagagccugagcggcggccaggaccugaccauggacggccugguggaccugaccgugggcgcccagggccacgugcugcugcugagaagccagcccgugcugagagugaaggccaucauggaguucaaccccagagagguggccagaaacguguucgagugcaacgaccagguggugaagggcaaggaggccggcgaggugagagugugccugcacgugcagaagagcaccagagacagacugagagagggccagauccagagcguggugaccuacgaccuggcccuggacagcggcagaccccacagcagagccguguucaacgagaccaagaacagcaccagaagacagacccaggugcugggccugacccagaccugcgagacccugaagcugcagcugcccaacugcaucgaggaccccgugagccccaucgugcugagacugaacuucagccuggugggcaccccccugagcgccuucggcaaccugagacccgugcuggccgaggacgcccagagacuguucaccgcccuguuccccuucgagaagaacugcggcaacgacaacaucugccaggacgaccugagcaucaccuucagcuucaugagccuggacugccugguggugggcggccccagagaguucaacgugaccgugaccgugagaaacgacggcgaggacagcuacagaacccaggugaccuucuucuucccccuggaccugagcuacagaaaggugagcacccugcagaaccagagaagccagagaagcuggagacuggccugcgagagcgccagcagcaccgaggugagcggcgcccugaagagcaccagcugcagcaucaaccaccccaucuuccccgagaacagcgaggugaccuucaacaucaccuucgacguggacagcaaggccagccugggcaacaagcugcugcugaaggccaacgugaccagcgagaacaacaugcccagaaccaacaagaccgaguuccagcuggagcugcccgugaaguacgccguguacaugguggugaccagccacggcgugagcaccaaguaccugaacuucaccgccagcgagaacaccagcagagugaugcagcaccaguaccaggugagcaaccugggccagagaagccugcccaucagccugguguuccuggugcccgugagacugaaccagaccgugaucugggacagaccccaggugaccuucagcgagaaccugagcagcaccugccacaccaaggagagacugcccagccacagcgacuuccuggccgagcugagaaaggcccccguggugaacugcagcaucgccgugugccagagaauccagugcgacauccccuucuucggcauccaggaggaguucaacgccacccugaagggcaaccugagcuucgacugguacaucaagaccagccacaaccaccugcugaucgugagcaccgccgagauccuguucaacgacagcguguucacccugcugcccggccagggcgccuucgugagaagccagaccgagaccaagguggagcccuucgaggugcccaacccccugccccugaucgugggcagcagcgugggcggccugcugcugcuggcccugaucaccgccgcccuguacaagcugggcuucuucaagagacaguacaaggacaugaugagcgagggcggcccccccggcgccgagccccagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6669 - RNA, 1680 nt, Artificial Sequence
  mRNA product Design5 comprising derived and/or modified sequence from Homo sapiens__NP_002415.1__HsMMP8 (opt4)
gggagagucccgcagucggcguccagcggcucugcuuguucgugugugugucguugcaggccuuauucaagcuuaccauguucagccugaagacccugcccuuccugcugcugcugcacgugcagaucagcaaggccuuccccgugagcagcaaggagaagaacaccaagaccgugcaggacuaccuggagaaguucuaccagcugcccagcaaccaguaccagagcaccagaaagaacggcaccaacgugaucguggagaagcugaaggagaugcagagauucuucggccugaacgugaccggcaagcccaacgaggagacccuggacaugaugaagaagcccagaugcggcgugcccgacagcggcggcuucaugcugacccccggcaaccccaagugggagagaaccaaccugaccuacagaaucagaaacuacaccccccagcugagcgaggccgagguggagagagccaucaaggacgccuucgagcuguggagcguggccagcccccugaucuucaccagaaucagccagggcgaggccgacaucaacaucgccuucuaccagagagaccacggcgacaacagccccuucgacggccccaacggcauccuggcccacgccuuccagcccggccagggcaucggcggcgacgcccacuucgacgccgaggagaccuggaccaacaccagcgccaacuacaaccuguuccugguggccgcccacgaguucggccacagccugggccuggcccacagcagcgaccccggcgcccugauguaccccaacuacgccuucagagagaccagcaacuacagccugccccaggacgacaucgacggcauccaggccaucuacggccugagcagcaaccccauccagcccaccggccccagcacccccaagcccugcgaccccagccugaccuucgacgccaucaccacccugagaggcgagauccuguucuucaaggacagauacuucuggagaagacacccccagcugcagagaguggagaugaacuucaucagccuguucuggcccagccugcccaccggcauccaggccgccuacgaggacuucgacagagaccugaucuuccuguucaagggcaaccaguacugggcccugagcggcuacgacauccugcagggcuaccccaaggacaucagcaacuacggcuuccccagcagcgugcaggccaucgacgccgccguguucuacagaagcaagaccuacuucuucgugaacgaccaguucuggagauacgacaaccagagacaguucauggagcccggcuaccccaagagcaucagcggcgccuuccccggcaucgagagcaagguggacgccguguuccagcaggagcacuucuuccacguguucagcggccccagauacuacgccuucgaccugaucgcccagagagugaccagaguggccagaggcaacaaguggcugaacugcagauacggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6670 - RNA, 2400 nt, Artificial Sequence
  mRNA product Design5 comprising derived and/or modified sequence from Homo sapiens__NP_004985.2__HsMMP9 (opt4)
gggagagucccgcagucggcguccagcggcucugcuuguucgugugugugucguugcaggccuuauucaagcuuaccaugagccuguggcagccccuggugcuggugcugcuggugcugggcugcugcuucgccgcccccagacagagacagagcacccuggugcuguuccccggcgaccugagaaccaaccugaccgacagacagcuggccgaggaguaccuguacagauacggcuacaccagaguggccgagaugagaggcgagagcaagagccugggccccgcccugcugcugcugcagaagcagcugagccugcccgagaccggcgagcuggacagcgccacccugaaggccaugagaacccccagaugcggcgugcccgaccugggcagauuccagaccuucgagggcgaccugaaguggcaccaccacaacaucaccuacuggauccagaacuacagcgaggaccugcccagagccgugaucgacgacgccuucgccagagccuucgcccuguggagcgccgugaccccccugaccuucaccagaguguacagcagagacgccgacaucgugauccaguucggcguggccgagcacggcgacggcuaccccuucgacggcaaggacggccugcuggcccacgccuucccccccggccccggcauccagggcgacgcccacuucgacgacgacgagcuguggagccugggcaagggcgugguggugcccaccagauucggcaacgccgacggcgccgccugccacuuccccuucaucuucgagggcagaagcuacagcgccugcaccaccgacggcagaagcgacggccugcccuggugcagcaccaccgccaacuacgacaccgacgacagauucggcuucugccccagcgagagacuguacacccaggacggcaacgccgacggcaagcccugccaguuccccuucaucuuccagggccagagcuacagcgccugcaccaccgacggcagaagcgacggcuacagauggugcgccaccaccgccaacuacgacagagacaagcuguucggcuucugccccaccagagccgacagcaccgugaugggcggcaacagcgccggcgagcugugcguguuccccuucaccuuccugggcaaggaguacagcaccugcaccagcgagggcagaggcgacggcagacuguggugcgccaccaccagcaacuucgacagcgacaagaaguggggcuucugccccgaccagggcuacagccuguuccugguggccgcccacgaguucggccacgcccugggccuggaccacagcagcgugcccgaggcccugauguaccccauguacagauucaccgagggccccccccugcacaaggacgacgugaacggcaucagacaccuguacggccccagacccgagcccgagcccagaccccccaccaccaccaccccccagcccaccgccccccccaccgugugccccaccggcccccccaccgugcaccccagcgagagacccaccgccggccccaccggcccccccagcgccggccccaccggcccccccaccgccggccccagcaccgccaccaccgugccccugagccccguggacgacgccugcaacgugaacaucuucgacgccaucgccgagaucggcaaccagcuguaccuguucaaggacggcaaguacuggagauucagcgagggcagaggcagcagaccccagggccccuuccugaucgccgacaaguggcccgcccugcccagaaagcuggacagcguguucgaggagagacugagcaagaagcuguucuucuucagcggcagacagguguggguguacaccggcgccagcgugcugggccccagaagacuggacaagcugggccugggcgccgacguggcccaggugaccggcgcccugagaagcggcagaggcaagaugcugcuguucagcggcagaagacuguggagauucgacgugaaggcccagaugguggaccccagaagcgccagcgagguggacagaauguuccccggcgugccccuggacacccacgacguguuccaguacagagagaaggccuacuucugccaggacagauucuacuggagagugagcagcagaagcgagcugaaccagguggaccaggugggcuacgugaccuacgacauccugcagugccccgaggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6671 - RNA, 1692 nt, Artificial Sequence
  mRNA product Design5 comprising derived and/or modified sequence from Homo sapiens__NP_002418.1__HsMMP13 (opt4)
gggagagucccgcagucggcguccagcggcucugcuuguucgugugugugucguugcaggccuuauucaagcuuaccaugcaccccggcgugcuggccgccuuccuguuccugagcuggacccacugcagagcccugccccugcccagcggcggcgacgaggacgaccugagcgaggaggaccugcaguucgccgagagauaccugagaagcuacuaccaccccaccaaccuggccggcauccugaaggagaacgccgccagcagcaugaccgagagacugagagagaugcagagcuucuucggccuggaggugaccggcaagcuggacgacaacacccuggacgugaugaagaagcccagaugcggcgugcccgacgugggcgaguacaacguguuccccagaacccugaaguggagcaagaugaaccugaccuacagaaucgugaacuacacccccgacaugacccacagcgagguggagaaggccuucaagaaggccuucaagguguggagcgacgugaccccccugaacuucaccagacugcacgacggcaucgccgacaucaugaucagcuucggcaucaaggagcacggcgacuucuaccccuucgacggccccagcggccugcuggcccacgccuucccccccggccccaacuacggcggcgacgcccacuucgacgacgacgagaccuggaccagcagcagcaagggcuacaaccuguuccugguggccgcccacgaguucggccacagccugggccuggaccacagcaaggaccccggcgcccugauguuccccaucuacaccuacaccggcaagagccacuucaugcugcccgacgacgacgugcagggcauccagagccuguacggccccggcgacgaggaccccaaccccaagcaccccaagacccccgacaagugcgaccccagccugagccuggacgccaucaccagccugagaggcgagaccaugaucuucaaggacagauucuucuggagacugcacccccagcagguggacgccgagcuguuccugaccaagagcuucuggcccgagcugcccaacagaaucgacgccgccuacgagcaccccagccacgaccugaucuucaucuucagaggcagaaaguucugggcccugaacggcuacgacauccuggagggcuaccccaagaagaucagcgagcugggccugcccaaggaggugaagaagaucagcgccgccgugcacuucgaggacaccggcaagacccugcuguucagcggcaaccagguguggagauacgacgacaccaaccacaucauggacaaggacuaccccagacugaucgaggaggacuuccccggcaucggcgacaagguggacgccguguacgagaagaacggcuacaucuacuucuucaacggccccauccaguucgaguacagcaucuggagcaacagaaucgugagagugaugcccgccaacagcauccuguggugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6672 - RNA, 1344 nt, Artificial Sequence
  mRNA product Design5 comprising derived and/or modified sequence from Homo sapiens__NP_001286.1__HsCCR1 (opt4)
gggagagucccgcagucggcguccagcggcucugcuuguucgugugugugucguugcaggccuuauucaagcuuaccauggagacccccaacaccaccgaggacuacgacaccaccaccgaguucgacuacggcgacgccacccccugccagaaggugaacgagagagccuucggcgcccagcugcugcccccccuguacagccugguguucgugaucggccuggugggcaacauccugguggugcuggugcuggugcaguacaagagacugaagaacaugaccagcaucuaccugcugaaccuggccaucagcgaccugcuguuccuguucacccugcccuucuggaucgacuacaagcugaaggacgacuggguguucggcgacgccaugugcaagauccugagcggcuucuacuacaccggccuguacagcgagaucuucuucaucauccugcugaccaucgacagauaccuggccaucgugcacgccguguucgcccugagagccagaaccgugaccuucggcgugaucaccagcaucaucaucugggcccuggccauccuggccagcaugcccggccuguacuucagcaagacccagugggaguucacccaccacaccugcagccugcacuucccccacgagagccugagagaguggaagcuguuccaggcccugaagcugaaccuguucggccuggugcugccccugcuggugaugaucaucugcuacaccggcaucaucaagauccugcugagaagacccaacgagaagaagagcaaggccgugagacugaucuucgugaucaugaucaucuucuuccuguucuggacccccuacaaccugaccauccugaucagcguguuccaggacuuccuguucacccacgagugcgagcagagcagacaccuggaccuggccgugcaggugaccgaggugaucgccuacacccacugcugcgugaaccccgugaucuacgccuucgugggcgagagauucagaaaguaccugagacagcuguuccacagaagaguggccgugcaccuggugaaguggcugcccuuccugagcguggacagacuggagagagugagcagcaccagccccagcaccggcgagcacgagcugagcgccggcuucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6673 - RNA, 912 nt, Artificial Sequence
  mRNA product Design5 comprising derived and/or modified sequence from Homo sapiens__NP_002598.4__HsPDGFA (opt4)
gggagagucccgcagucggcguccagcggcucugcuuguucgugugugugucguugcaggccuuauucaagcuuaccaugagaacccuggccugccugcugcugcugggcugcggcuaccuggcccacgugcuggccgaggaggccgagauccccagagaggugaucgagagacuggccagaagccagauccacagcaucagagaccugcagagacugcuggagaucgacagcgugggcagcgaggacagccuggacaccagccugagagcccacggcgugcacgccaccaagcacgugcccgagaagagaccccugcccaucagaagaaagagaagcaucgaggaggccgugcccgccgugugcaagaccagaaccgugaucuacgagauccccagaagccagguggaccccaccagcgccaacuuccugaucuggccccccugcguggaggugaagagaugcaccggcugcugcaacaccagcagcgugaagugccagcccagcagagugcaccacagaagcgugaagguggccaagguggaguacgugagaaagaagcccaagcugaaggaggugcaggugagacuggaggagcaccuggagugcgccugcgccaccaccagccugaaccccgacuacagagaggaggacaccggcagacccagagagagcggcaagaagagaaagagaaagagacugaagcccaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6674 - RNA, 1002 nt, Artificial Sequence
  mRNA product Design5 comprising derived and/or modified sequence from Homo sapiens__NP_002599.1__HsPDGFB (opt4)
gggagagucccgcagucggcguccagcggcucugcuuguucgugugugugucguugcaggccuuauucaagcuuaccaugaacagaugcugggcccuguuccugagccugugcugcuaccugagacuggugagcgccgagggcgaccccauccccgaggagcuguacgagaugcugagcgaccacagcaucagaagcuucgacgaccugcagagacugcugcacggcgaccccggcgaggaggacggcgccgagcuggaccugaacaugaccagaagccacagcggcggcgagcuggagagccuggccagaggcagaagaagccugggcagccugaccaucgccgagcccgccaugaucgccgagugcaagaccagaaccgagguguucgagaucagcagaagacugaucgacagaaccaacgccaacuuccugguguggccccccugcguggaggugcagagaugcagcggcugcugcaacaacagaaacgugcagugcagacccacccaggugcagcugagacccgugcaggugagaaagaucgagaucgugagaaagaagcccaucuucaagaaggccaccgugacccuggaggaccaccuggccugcaagugcgagaccguggccgccgccagacccgugaccagaagccccggcggcagccaggagcagagagccaagaccccccagaccagagugaccaucagaaccgugagagugagaagaccccccaagggcaagcacagaaaguucaagcacacccacgacaagaccgcccugaaggagacccugggcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6675 - RNA, 1314 nt, Artificial Sequence
  mRNA product Design5 comprising derived and/or modified sequence from Homo sapiens__NP_057289.1__HsPDGFC (opt4)
gggagagucccgcagucggcguccagcggcucugcuuguucgugugugugucguugcaggccuuauucaagcuuaccaugagccuguucggccugcugcugcugaccagcgcccuggccggccagagacagggcacccaggccgagagcaaccugagcagcaaguuccaguucagcagcaacaaggagcagaacggcgugcaggacccccagcacgagagaaucaucaccgugagcaccaacggcagcauccacagccccagauucccccacaccuaccccagaaacaccgugcugguguggagacugguggccguggaggagaacguguggauccagcugaccuucgacgagagauucggccuggaggaccccgaggacgacaucugcaaguacgacuucguggagguggaggagcccagcgacggcaccauccugggcagauggugcggcagcggcaccgugcccggcaagcagaucagcaagggcaaccagaucagaaucagauucgugagcgacgaguacuuccccagcgagcccggcuucugcauccacuacaacaucgugaugccccaguucaccgaggccgugagccccagcgugcugccccccagcgcccugccccuggaccugcugaacaacgccaucaccgccuucagcacccuggaggaccugaucagauaccuggagcccgagagauggcagcuggaccuggaggaccuguacagacccaccuggcagcugcugggcaaggccuucguguucggcagaaagagcagagugguggaccugaaccugcugaccgaggaggugagacuguacagcugcacccccagaaacuucagcgugagcaucagagaggagcugaagagaaccgacaccaucuucuggcccggcugccugcuggugaagagaugcggcggcaacugcgccugcugccugcacaacugcaacgagugccagugcgugcccagcaaggugaccaagaaguaccacgaggugcugcagcugagacccaagaccggcgugagaggccugcacaagagccugaccgacguggcccuggagcaccacgaggagugcgacugcgugugcagaggcagcaccggcggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6676 - RNA, 1371 nt, Artificial Sequence
  mRNA product Design5 comprising derived and/or modified sequence from Homo sapiens__NP_149126.1__HsPDGFD (opt4)
gggagagucccgcagucggcguccagcggcucugcuuguucgugugugugucguugcaggccuuauucaagcuuaccaugcacagacugaucuucguguacacccugaucugcgccaacuucugcagcugcagagacaccagcgccaccccccagagcgccagcaucaaggcccugagaaacgccaaccugagaagagacgaccuguacagaagagacgagaccauccaggugaagggcaacggcuacgugcagagccccagauuccccaacagcuaccccagaaaccugcugcugaccuggagacugcacagccaggagaacaccagaauccagcugguguucgacaaccaguucggccuggaggaggccgagaacgacaucugcagauacgacuucguggagguggaggacaucagcgagaccagcaccaucaucagaggcagauggugcggccacaaggaggugccccccagaaucaagagcagaaccaaccagaucaagaucaccuucaagagcgacgacuacuucguggccaagcccggcuucaagaucuacuacagccugcuggaggacuuccagcccgccgccgccagcgagaccaacugggagagcgugaccagcagcaucagcggcgugagcuacaacagccccagcgugaccgaccccacccugaucgccgacgcccuggacaagaagaucgccgaguucgacaccguggaggaccugcugaaguacuucaaccccgagagcuggcaggaggaccuggagaacauguaccuggacacccccagauacagaggcagaagcuaccacgacagaaagagcaagguggaccuggacagacugaacgacgacgccaagagauacagcugcacccccagaaacuacagcgugaacaucagagaggagcugaagcuggccaacgugguguucuuccccagaugccugcuggugcagagaugcggcggcaacugcggcugcggcaccgugaacuggagaagcugcaccugcaacagcggcaagaccgugaagaaguaccacgaggugcugcaguucgagcccggccacaucaagagaagaggcagagccaagaccauggcccugguggacauccagcuggaccaccacgagagaugcgacugcaucugcagcagcagaccccccagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6677 - RNA, 954 nt, Artificial Sequence
  mRNA product Design5 comprising derived and/or modified sequence from Homo sapiens__NP_003946.3__HsSOCS3 (opt4)
gggagagucccgcagucggcguccagcggcucugcuuguucgugugugugucguugcaggccuuauucaagcuuaccauggugacccacagcaaguuccccgccgccggcaugagcagaccccuggacaccagccugagacugaagaccuucagcagcaagagcgaguaccagcugguggugaacgccgugagaaagcugcaggagagcggcuucuacuggagcgccgugaccggcggcgaggccaaccugcugcugagcgccgagcccgccggcaccuuccugaucagagacagcagcgaccagagacacuucuucacccugagcgugaagacccagagcggcaccaagaaccugagaauccagugcgagggcggcagcuucagccugcagagcgaccccagaagcacccagcccgugcccagauucgacugcgugcugaagcuggugcaccacuacaugcccccccccggcgcccccagcuuccccagcccccccaccgagcccagcagcgaggugcccgagcagcccagcgcccagccccugcccggcagcccccccagaagagccuacuacaucuacagcggcggcgagaagaucccccuggugcugagcagaccccugagcagcaacguggccacccugcagcaccugugcagaaagaccgugaacggccaccuggacagcuacgagaaggugacccagcugcccggccccaucagagaguuccuggaccaguacgacgccccccugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6678 - RNA, 759 nt, Artificial Sequence
  mRNA product Design5 comprising derived and/or modified sequence from Homo sapiens__NP_003227.1__HsTGFA (opt4)
gggagagucccgcagucggcguccagcggcucugcuuguucgugugugugucguugcaggccuuauucaagcuuaccauggugcccagcgccggccagcuggcccuguucgcccugggcaucgugcuggccgccugccaggcccuggagaacagcaccagcccccugagcgccgacccccccguggccgccgccguggugagccacuucaacgacugccccgacagccacacccaguucugcuuccacggcaccugcagauuccuggugcaggaggacaagcccgccugcgugugccacagcggcuacgugggcgccagaugcgagcacgccgaccugcuggccgugguggccgccagccagaagaagcaggccaucaccgcccuggugguggugagcaucguggcccuggccgugcugaucaucaccugcgugcugauccacugcugccaggugagaaagcacugcgaguggugcagagcccugaucugcagacacgagaagcccagcgcccugcugaagggcagaaccgccugcugccacagcgagaccguggugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6679 - RNA, 1449 nt, Artificial Sequence
  mRNA product Design5 comprising derived and/or modified sequence from Homo sapiens__NP_000651.3__HsTGFB1 (opt4)
gggagagucccgcagucggcguccagcggcucugcuuguucgugugugugucguugcaggccuuauucaagcuuaccaugccccccagcggccugagacugcugccccugcugcugccccugcuguggcugcuggugcugacccccggcagacccgccgccggccugagcaccugcaagaccaucgacauggagcuggugaagagaaagagaaucgaggccaucagaggccagauccugagcaagcugagacuggccagcccccccagccagggcgaggugccccccggcccccugcccgaggccgugcuggcccuguacaacagcaccagagacagaguggccggcgagagcgccgagcccgagcccgagcccgaggccgacuacuacgccaaggaggugaccagagugcugaugguggagacccacaacgagaucuacgacaaguucaagcagagcacccacagcaucuacauguucuucaacaccagcgagcugagagaggccgugcccgagcccgugcugcugagcagagccgagcugagacugcugagacugaagcugaagguggagcagcacguggagcuguaccagaaguacagcaacaacagcuggagauaccugagcaacagacugcuggcccccagcgacagccccgaguggcugagcuucgacgugaccggcguggugagacaguggcugagcagaggcggcgagaucgagggcuucagacugagcgcccacugcagcugcgacagcagagacaacacccugcagguggacaucaacggcuucaccaccggcagaagaggcgaccuggccaccauccacggcaugaacagacccuuccugcugcugauggccaccccccuggagagagcccagcaccugcagagcagcagacacagaagagcccuggacaccaacuacugcuucagcagcaccgagaagaacugcugcgugagacagcuguacaucgacuucagaaaggaccugggcuggaaguggauccacgagcccaagggcuaccacgccaacuucugccugggccccugccccuacaucuggagccuggacacccaguacagcaaggugcuggcccuguacaaccagcacaaccccggcgccagcgccgcccccugcugcgugccccaggcccuggagccccugcccaucguguacuacgugggcagaaagcccaagguggagcagcugagcaacaugaucgugagaagcugcaagugcagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6680 - RNA, 1521 nt, Artificial Sequence
  mRNA product Design5 comprising derived and/or modified sequence from Homo sapiens__NP_003229.1__HsTGFB2 (opt4)
gggagagucccgcagucggcguccagcggcucugcuuguucgugugugugucguugcaggccuuauucaagcuuaccaugcacuacugcgugcugagcgccuuccugauccugcaccuggugaccguggcccugagccugagcaccugcagcacccuggacauggaccaguucaugagaaagagaaucgaggccaucagaggccagauccugagcaagcugaagcugaccagcccccccgaggacuaccccgagcccgaggaggugccccccgaggugaucagcaucuacaacagcaccagagaccugcugcaggagaaggccagcagaagagccgccgccugcgagagagagagaagcgacgaggaguacuacgccaaggagguguacaagaucgacaugccccccuucuuccccagcgagaacgccaucccccccaccuucuacagacccuacuucagaaucgugagauucgacgugagcgccauggagaagaacgccagcaaccuggugaaggccgaguucagaguguucagacugcagaaccccaaggccagagugcccgagcagagaaucgagcuguaccagauccugaagagcaaggaccugaccagccccacccagagauacaucgacagcaagguggugaagaccagagccgagggcgaguggcugagcuucgacgugaccgacgccgugcacgaguggcugcaccacaaggacagaaaccugggcuucaagaucagccugcacugccccugcugcaccuucgugcccagcaacaacuacaucauccccaacaagagcgaggagcuggaggccagauucgccggcaucgacggcaccagcaccuacaccagcggcgaccagaagaccaucaagagcaccagaaagaagaacagcggcaagaccccccaccugcugcugaugcugcugcccagcuacagacuggagagccagcagaccaacagaagaaagaagagagcccuggacgccgccuacugcuucagaaacgugcaggacaacugcugccugagaccccuguacaucgacuucaagagagaccugggcuggaaguggauccacgagcccaagggcuacaacgccaacuucugcgccggcgccugccccuaccuguggagcagcgacacccagcacagcagagugcugagccuguacaacaccaucaaccccgaggccagcgccagccccugcugcgugagccaggaccuggagccccugaccauccuguacuacaucggcaagacccccaagaucgagcagcugagcaacaugaucgugaagagcugcaagugcagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6681 - RNA, 1515 nt, Artificial Sequence
  mRNA product Design5 comprising derived and/or modified sequence from Homo sapiens__NP_003230.1__HsTGFB3 (opt4)
gggagagucccgcagucggcguccagcggcucugcuuguucgugugugugucguugcaggccuuauucaagcuuaccaugaagaugcaccugcagagagcccugguggugcuggcccugcugaacuucgccaccgugagccugagccugagcaccugcaccacccuggacuucggccacaucaagaagaagagaguggaggccaucagaggccagauccugagcaagcugagacugaccagcccccccgagcccaccgugaugacccacgugcccuaccaggugcuggcccuguacaacagcaccagagagcugcuggaggagaugcacggcgagagagaggagggcugcacccaggagaacaccgagagcgaguacuacgccaaggagauccacaaguucgacaugauccagggccuggccgagcacaacgagcuggccgugugccccaagggcaucaccagcaagguguucagauucaacgugagcagcguggagaagaacagaaccaaccuguucagagccgaguucagagugcugagagugcccaaccccagcagcaagagaaacgagcagagaaucgagcuguuccagauccugagacccgacgagcacaucgccaagcagagauacaucggcggcaagaaccugcccaccagaggcaccgccgaguggcugagcuucgacgugaccgacaccgugagagaguggcugcugagaagagagagcaaccugggccuggagaucagcauccacugccccugccacaccuuccagcccaacggcgacauccuggagaacauccacgaggugauggagaucaaguucaagggcguggacaacgaggacgaccacggcagaggcgaccugggcagacugaagaagcagaaggaccaccacaacccccaccugauccugaugaugauccccccccacagacuggacaaccccggccagggcggccagagaaagaagagagcccuggacaccaacuacugcuucagaaaccuggaggagaacugcugcgugagaccccuguacaucgacuucagacaggaccugggcuggaagugggugcacgagcccaagggcuacuacgccaacuucugcagcggccccugccccuaccugagaagcgccgacaccacccacagcaccgugcugggccuguacaacacccugaaccccgaggccagcgccagccccugcugcgugccccaggaccuggagccccugaccauccuguacuacgugggcagaacccccaagguggagcagcugagcaacaugguggugaagagcugcaagugcagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6682 - RNA, 1662 nt, Artificial Sequence
  mRNA product Design5 comprising derived and/or modified sequence from Homo sapiens__NP_001057.1__HsTNFRSF1B (opt4)
gggagagucccgcagucggcguccagcggcucugcuuguucgugugugugucguugcaggccuuauucaagcuuaccauggcccccguggccgugugggccgcccuggccgugggccuggagcugugggccgccgcccacgcccugcccgcccagguggccuucacccccuacgcccccgagcccggcagcaccugcagacugagagaguacuacgaccagaccgcccagaugugcugcagcaagugcagccccggccagcacgccaagguguucugcaccaagaccagcgacaccgugugcgacagcugcgaggacagcaccuacacccagcuguggaacugggugcccgagugccugagcugcggcagcagaugcagcagcgaccagguggagacccaggccugcaccagagagcagaacagaaucugcaccugcagacccggcugguacugcgcccugagcaagcaggagggcugcagacugugcgccccccugagaaagugcagacccggcuucggcguggccagacccggcaccgagaccagcgacguggugugcaagcccugcgcccccggcaccuucagcaacaccaccagcagcaccgacaucugcagaccccaccagaucugcaacgugguggccauccccggcaacgccagcauggacgccgugugcaccagcaccagccccaccagaagcauggcccccggcgccgugcaccugccccagcccgugagcaccagaagccagcacacccagcccacccccgagcccagcaccgcccccagcaccagcuuccugcugcccaugggccccagcccccccgccgagggcagcaccggcgacuucgcccugcccgugggccugaucgugggcgugaccgcccugggccugcugaucaucggcguggugaacugcgugaucaugacccaggugaagaagaagccccugugccugcagagagaggccaaggugccccaccugcccgccgacaaggccagaggcacccagggccccgagcagcagcaccugcugaucaccgcccccagcagcagcagcagcagccuggagagcagcgccagcgcccuggacagaagagcccccaccagaaaccagccccaggcccccggcguggaggccagcggcgccggcgaggccagagccagcaccggcagcagcgacagcagccccggcggccacggcacccaggugaacgugaccugcaucgugaacgugugcagcagcagcgaccacagcagccagugcagcagccaggccagcagcaccaugggcgacaccgacagcagccccagcgagagccccaaggacgagcaggugcccuucagcaaggaggagugcgccuucagaagccagcuggagacccccgagacccugcugggcagcaccgaggagaagccccugccccugggcgugcccgacgccggcaugaagcccagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6683 - RNA, 789 nt, Artificial Sequence
  mRNA product Design5 comprising derived and/or modified sequence from Homo sapiens__NP_002623.2__HsPGF (opt4)
gggagagucccgcagucggcguccagcggcucugcuuguucgugugugugucguugcaggccuuauucaagcuuaccaugcccgugaugagacuguuccccugcuuccugcagcugcuggccggccuggcccugcccgccgugcccccccagcagugggcccugagcgccggcaacggcagcagcgagguggagguggugcccuuccaggagguguggggcagaagcuacugcagagcccuggagagacugguggacguggugagcgaguaccccagcgagguggagcacauguucagccccagcugcgugagccugcugagaugcaccggcugcugcggcgacgagaaccugcacugcgugcccguggagaccgccaacgugaccaugcagcugcugaagaucagaagcggcgacagacccagcuacguggagcugaccuucagccagcacgugagaugcgagugcagaccccugagagagaagaugaagcccgagagaagaagacccaagggcagaggcaagagaagaagagagaagcagagacccaccgacugccaccugugcggcgacgccgugcccagaagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6684 - RNA, 1515 nt, Artificial Sequence
  mRNA product Design5 comprising derived and/or modified sequence from Homo sapiens__NP_001020537.2__HsVEGFA (opt4)
gggagagucccgcagucggcguccagcggcucugcuuguucgugugugugucguugcaggccuuauucaagcuuaccaugaccgacagacagaccgacaccgcccccagccccagcuaccaccugcugcccggcagaagaagaaccguggacgccgccgccagcagaggccagggccccgagcccgcccccggcggcggcguggagggcgugggcgccagaggcguggcccugaagcuguucgugcagcugcugggcugcagcagauucggcggcgccguggugagagccggcgaggccgagcccagcggcgccgccagaagcgccagcagcggcagagaggagccccagcccgaggagggcgaggaggaggaggagaaggaggaggagagaggcccccaguggagacugggcgccagaaagcccggcagcuggaccggcgaggccgccgugugcgccgacagcgcccccgccgccagagccccccaggcccuggccagagccagcggcagaggcggcagaguggccagaagaggcgccgaggagagcggccccccccacagccccagcagaagaggcagcgccagcagagccggccccggcagagccagcgagaccaugaacuuccugcugagcugggugcacuggagccuggcccugcugcuguaccugcaccacgccaaguggagccaggccgcccccauggccgagggcggcggccagaaccaccacgagguggugaaguucauggacguguaccagagaagcuacugccaccccaucgagacccugguggacaucuuccaggaguaccccgacgagaucgaguacaucuucaagcccagcugcgugccccugaugagaugcggcggcugcugcaacgacgagggccuggagugcgugcccaccgaggagagcaacaucaccaugcagaucaugagaaucaagccccaccagggccagcacaucggcgagaugagcuuccugcagcacaacaagugcgagugcagacccaagaaggacagagccagacaggagaagaagagcgugagaggcaagggcaagggccagaagagaaagagaaagaagagcagauacaagagcuggagcguguacgugggcgccagaugcugccugaugcccuggagccugcccggcccccaccccugcggccccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6685 - RNA, 975 nt, Artificial Sequence
  mRNA product Design5 comprising derived and/or modified sequence from Homo sapiens__NP_001165094.1__HsVEGFA (opt4)
gggagagucccgcagucggcguccagcggcucugcuuguucgugugugugucguugcaggccuuauucaagcuuaccaugaacuuccugcugagcugggugcacuggagccuggcccugcugcuguaccugcaccacgccaaguggagccaggccgcccccauggccgagggcggcggccagaaccaccacgagguggugaaguucauggacguguaccagagaagcuacugccaccccaucgagacccugguggacaucuuccaggaguaccccgacgagaucgaguacaucuucaagcccagcugcgugccccugaugagaugcggcggcugcugcaacgacgagggccuggagugcgugcccaccgaggagagcaacaucaccaugcagaucaugagaaucaagccccaccagggccagcacaucggcgagaugagcuuccugcagcacaacaagugcgagugcagacccaagaaggacagagccagacaggagaagaagagcgugagaggcaagggcaagggccagaagagaaagagaaagaagagcagauacaagagcuggagcguguacgugggcgccagaugcugccugaugcccuggagccugcccggcccccaccccugcggccccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6686 - RNA, 900 nt, Artificial Sequence
  mRNA product Design5 comprising derived and/or modified sequence from Homo sapiens__NP_003368.1__HsVEGFB (opt4)
gggagagucccgcagucggcguccagcggcucugcuuguucgugugugugucguugcaggccuuauucaagcuuaccaugagcccccugcugagaagacugcugcuggccgcccugcugcagcuggcccccgcccaggcccccgugagccagcccgacgcccccggccaccagagaaagguggugagcuggaucgacguguacaccagagccaccugccagcccagagaggugguggugccccugaccguggagcugaugggcaccguggccaagcagcuggugcccagcugcgugaccgugcagagaugcggcggcugcugccccgacgacggccuggagugcgugcccaccggccagcaccaggugagaaugcagauccugaugaucagauaccccagcagccagcugggcgagaugagccuggaggagcacagccagugcgagugcagacccaagaagaaggacagcgccgugaagcccgacagagccgccaccccccaccacagaccccagcccagaagcgugcccggcugggacagcgcccccggcgcccccagccccgccgacaucacccaccccacccccgcccccggccccagcgcccacgccgcccccagcaccaccagcgcccugacccccggccccgccgccgccgccgccgacgccgccgccagcagcguggccaagggcggcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6687 - RNA, 1536 nt, Artificial Sequence
  mRNA product Design5 comprising derived and/or modified sequence from Homo sapiens__NP_005420.1__HsVEGFC (opt4)
gggagagucccgcagucggcguccagcggcucugcuuguucgugugugugucguugcaggccuuauucaagcuuaccaugcaccugcugggcuucuucagcguggccugcagccugcuggccgccgcccugcugcccggccccagagaggcccccgccgccgccgccgccuucgagagcggccuggaccugagcgacgccgagcccgacgccggcgaggccaccgccuacgccagcaaggaccuggaggagcagcugagaagcgugagcagcguggacgagcugaugaccgugcuguaccccgaguacuggaagauguacaagugccagcugagaaagggcggcuggcagcacaacagagagcaggccaaccugaacagcagaaccgaggagaccaucaaguucgccgccgcccacuacaacaccgagauccugaagagcaucgacaacgaguggagaaagacccagugcaugcccagagaggugugcaucgacgugggcaaggaguucggcguggccaccaacaccuucuucaagccccccugcgugagcguguacagaugcggcggcugcugcaacagcgagggccugcagugcaugaacaccagcaccagcuaccugagcaagacccuguucgagaucaccgugccccugagccagggccccaagcccgugaccaucagcuucgccaaccacaccagcugcagaugcaugagcaagcuggacguguacagacaggugcacagcaucaucagaagaagccugcccgccacccugccccagugccaggccgccaacaagaccugccccaccaacuacauguggaacaaccacaucugcagaugccuggcccaggaggacuucauguucagcagcgacgccggcgacgacagcaccgacggcuuccacgacaucugcggccccaacaaggagcuggacgaggagaccugccagugcgugugcagagccggccugagacccgccagcugcggcccccacaaggagcuggacagaaacagcugccagugcgugugcaagaacaagcuguuccccagccagugcggcgccaacagagaguucgacgagaacaccugccagugcgugugcaagagaaccugccccagaaaccagccccugaaccccggcaagugcgccugcgagugcaccgagagcccccagaagugccugcugaagggcaagaaguuccaccaccagaccugcagcugcuacagaagacccugcaccaacagacagaaggccugcgagcccggcuucagcuacagcgaggaggugugcagaugcgugcccagcuacuggaagagaccccagaugagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6688 - RNA, 1341 nt, Artificial Sequence
  mRNA product Design5 comprising derived and/or modified sequence from Homo sapiens__NP_004460.1__HsVEGFD (opt4)
gggagagucccgcagucggcguccagcggcucugcuuguucgugugugugucguugcaggccuuauucaagcuuaccauguacagagagugggugguggugaacguguucaugaugcuguacgugcagcuggugcagggcagcagcaacgagcacggccccgugaagagaagcagccagagcacccuggagagaagcgagcagcagaucagagccgccagcagccuggaggagcugcugagaaucacccacagcgaggacuggaagcuguggagaugcagacugagacugaagagcuucaccagcauggacagcagaagcgccagccacagaagcaccagauucgccgccaccuucuacgacaucgagacccugaaggugaucgacgaggaguggcagagaacccagugcagccccagagagaccugcguggagguggccagcgagcugggcaagagcaccaacaccuucuucaagccccccugcgugaacguguucagaugcggcggcugcugcaacgaggagagccugaucugcaugaacaccagcaccagcuacaucagcaagcagcuguucgagaucagcgugccccugaccagcgugcccgagcuggugcccgugaagguggccaaccacaccggcugcaagugccugcccaccgcccccagacaccccuacagcaucaucagaagaagcauccagauccccgaggaggacagaugcagccacagcaagaagcugugccccaucgacaugcugugggacagcaacaagugcaagugcgugcugcaggaggagaacccccuggccggcaccgaggaccacagccaccugcaggagcccgcccugugcggcccccacaugauguucgacgaggacagaugcgagugcgugugcaagacccccugccccaaggaccugauccagcaccccaagaacugcagcugcuucgagugcaaggagagccuggagaccugcugccagaagcacaagcuguuccaccccgacaccugcagcugcgaggacagaugccccuuccacaccagacccugcgccagcggcaagaccgccugcgccaagcacugcagauuccccaaggagaagagagccgcccagggcccccacagcagaaagaaccccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6689 - RNA, 906 nt, Artificial Sequence
  mRNA product Design5 comprising derived and/or modified sequence from Homo sapiens__NP_061986.1__HsFGF21 (opt5)
gggagagucccgcagucggcguccagcggcucugcuuguucgugugugugucguugcaggccuuauucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagcugcuucuggaagauggcuauaacguguaccaguccgaggcccacgggcucccccugcaucugccuggaaauaaaagcccgcacagagaccccgcgccucggggccccgcccgcuuucucccucugcccgggcuuccgccugcucugcccgaaccucccggaauccucgcuccccagccuccggauguugggucuuccgacccccugagcauggugggcccuucucaggggagaucccccagcuaugccucuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6690 - RNA, 1686 nt, Artificial Sequence
  mRNA product Design5 comprising derived and/or modified sequence from Homo sapiens__NP_002412.1__HsMMP1 (opt5)
gggagagucccgcagucggcguccagcggcucugcuuguucgugugugugucguugcaggccuuauucaagcuuaccaugcacagcuuucccccucugcuccugcuucuguucuggggcguggucucccauucuuucccggccacccucgagacacaggaacaagacguugaucuggugcagaaguaccuugagaaauauuacaaccugaagaaugacgggagacagguggaaaaacggcgcaacagcggacccgucguggagaagcucaaacagaugcaagaauuuuucggccugaagguuacggggaagccugaugcugagacccugaaagugaugaagcagcccagaugcggagucccugacguggcccaguuuguucucacagagggcaauccccggugggaacagacccaccugacauaucgcaucgagaacuacaccccugaucuuccgagagcggacguggaucaugcuauugaaaaagccuuccaacugugguccaaugucacaccccucaccuuuacgaaggugucugaggggcaggccgacaucaugauuagcuucgugcggggagaucaccgcgacaacuccccuuuugauggccccggcgggaaucuggcucaugccuuccagccuggacccggcaucgggggagacgcucacuuugaugaggacgaaagauggaccaacaauuuccgggaguauaaccuucaccgcgucgccgcgcaugaacugggccacucucucgggcugagccauuccacagacauuggagcccugauguacccgagcuauaccuuuucuggcgauguucagcucgcucaagacgauaucgacggcauccaggccauuuacgggagaucccagaauccugugcaacccaucggaccucagacacccaaggcuugugauagcaaacugaccuucgacgccauuacgacaauccggggcgaggugauguucuuuaaggaucgcuucuacaugagaaccaaccccuuuuauccugaagucgagcuuaauuucauuucuguguuuuggccgcagcugcccaacgggcucgaggcggccuacgaguucgcugaccgggaugaaguucgcuuuuucaaaggaaauaaguauugggccgugcagggccaaaacguccugcacggguacccuaaagacaucuauuccagcuuuggauuccccagaacagugaagcacauugaugcugcccuuucugaagagaacaccggcaaaaccuacuuuuucguugccaauaaguauuggcgguacgacgaauacaaaagauccauggacccuggcuaucccaagaugaucgcucaugauuuuccggggaucggacacaagguggacgcggucuucaugaaagauggcuucuuuuacuucuuucaugggacacgccaguauaaguucgacccuaaaacgaagcggauucugacccuccagaaagccaacagcugguuuaauugcagaaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6691 - RNA, 1446 nt, Artificial Sequence
  mRNA product Design5 comprising derived and/or modified sequence from Homo sapiens__NP_002412.1__HsMMP1(1-19,100-469) (opt5)
gggagagucccgcagucggcguccagcggcucugcuuguucgugugugugucguugcaggccuuauucaagcuuaccaugcacagcuuucccccucugcuccugcuucuguucuggggcguggucucccauucuuucguucucaccgaggggaacccgagaugggaacagacacaccugacguaccggauugagaauuauacccccgaccuuccucgcgccgauguggaccaugcuauugaaaaggccuuucaacuguggagcaacgugacaccccucaccuucacaaaagucuccgagggacaggcggauaucaugauuucuuuugugagaggcgaccaccgggauaauagcccuuucgacgggcccggaggcaaccuggcucaugccuuucagccugggccgggaaucggcggcgaugcccacuucgacgaagaugagcgcuggaccaauaacuuuagagaguacaaucugcaccggguugcugcccaugaacucgggcacucccugggacuuucucauagcacagacauuggcgcucugauguaucccuccuacaccuucagcggggaugugcagcucgcccaagacgauaucgacggaauccaggcgauuuauggccgcucucagaacccuguccagcccaucgggccucaaacgcccaaggccugcgacuccaaacugaccuuugaugcuauuacaaccaucagaggagaggugauguucuuuaaggaccgguucuacaugcgcacaaauccguucuauccugaaguugagcuuaacuuuauuagcguguucuggccccagcugccuaauggccucgaggccgcuuacgaauuugccgauagagacgagguccgguucuuuaaaggcaacaaguacugggcggugcaggggcagaaugugcugcacggauaucccaaggauaucuacucuuccuucggcuuuccccgcaccgucaaacacauugacgccgcucugagcgaagagaacacggggaagacauauuucuuuguugccaauaaauacuggagauaugaugaauacaagcggucuauggacccuggauauccgaaaaugaucgcucaugauuuccccggcaucgggcacaagguggacgccguguuuaugaaggauggauucuuuuacuucuuccauggcacccgccaauacaaauuugacccuaagacaaaaagaauccucacccugcagaaggccaacuccugguucaacugucggaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6692 - RNA, 3633 nt, Artificial Sequence
  mRNA product Design5 comprising derived and/or modified sequence from Clostridium histolyticum__BAA77453.1__ColG (opt5)
gggagagucccgcagucggcguccagcggcucugcuuguucgugugugugucguugcaggccuuauucaagcuuaccaugaagaaaaacauccugaagauucucauggacagcuacuccaaagagucuaagauccagaccgugagacgggucacaagcguuucccugcuugccguguaucugacgaugaauaccucuagccucgugcuggcuaaacccauugaaaacacaaaugauaccuccaucaagaacgucgagaaacuucgcaaugccccuaacgaagaaaauucuaaaaagguggaagacagcaaaaacgauaagguugagcacgugaaaaauauugaggaagcgaaggucgagcaaguggcuccggaaguuaaguccaaaagcacacugagaucugccuccaucgccaacaccaauagcgagaaguacgacuucgaguaucucaacggccugucuuacacagaacugaccaaucucaucaaaaacauuaaguggaaucagaucaacgggcuguuuaacuauuccacgggaagccagaaauucuuuggcgauaagaaucgggugcaggcuauuaucaacgcccuucaagagucugggcgcaccuacacagcuaaugacaugaaaggaauugaaaccuucacagagguccugagagccggcuuuuaucucggguacuacaacgauggacuguccuaucuuaaugaccggaacuuccaggauaagugcauccccgcgaugauugccauccagaagaauccuaacuuuaaacugggcaccgcugugcaggacgaagugaucacgagccucggcaagcugauugggaaugccuccgcuaacgccgaggucguuaauaacugugugcccgugcugaaacaauuccgcgagaaucucaaccaguacgcgccugauuaugucaagggaacagccgugaaugaacugaucaaaggcauugaguuugacuucucuggggcugccuacgaaaaggauguuaagaccaugcccugguauggaaaaaucgacccuuuuauuaacgagcuuaaggcucugggccucuacgggaacaucacaagcgccaccgaaugggccuccgacgugggaaucuauuaccugagcaaauucggccuuuacucuaccaauagaaacgauauuguccagucccuggagaaggcuguggacauguauaaauacggcaagaucgcguuuguugccauggagcggauuacaugggauuaugacgggaucggaagcaauggcaagaaaguggaucaugacaaguuccucgaugacgcugaaaaacacuaccugccgaagacguauaccuucgauaacgggacauuuauuauccgcgccggagacaaagucucugaggaaaagaucaagagacuguacugggccagccgggaggugaaaucccaguuccaucgcgucgugggcaaugauaaggcucucgaaguugggaacgccgacgacgugcugaccaugaaaauuuuuaauucucccgaggaguauaaguucaacacaaauaucaacggagucagcaccgauaauggcggccuuuacauugaaccuagagggacguuuuacacauaugagcggacaccccaacaguccaucuucagccuggaggagcucuuucgccacgaguacacccauuaucugcaggcgagauaccuuguggacggacuguggggccaagggccuuucuaugagaaaaaccggcucaccugguuugaugaaggaaccgcugaguucuuugccggcucuacaagaacguccgggguucugccccgcaagagcauucugggcuaccucgccaaagacaagguggaucaccgguauucucugaagaaaacccuuaauuccggauacgacgauagcgacuggauguucuacaacuauggcuuugcugucgcccacuaccuguaugaaaaggauaugccgacauucaucaaaaugaauaaggcuauucucaacaccgacgugaaauccuacgaugaaaucaucaagaagcugucugacgaugccaacaaaaauacagaguaucagaaccauauucaggagcuggcggacaaguaccagggggccggaaucccucuugugagcgacgauuaucucaaagaccacggcuacaagaaggcuuccgaaguuuacucugagauuagcaaggccgcuucccugaccaauacgagcgucaccgccgaaaagucucaauauuucaacacauuuacccugagagggacauacaccggagagacguccaaaggcgaguucaaggauugggacgaaaugagcaaaaagcucgaugggacacuggagucucuugcgaaaaauuccuggagcggcuauaagacccugacagccuacuuuaccaacuaucgcgugaccucugacaauaaggugcaguacgaugucguguuccauggaguucucacagacaacgcugauaucagcaauaacaaagcccccauugcuaaggugacgggcccuuccaccggggccgucggacggaauaucgaauuuagcggcaaagacucuaaggaugaggacgggaaaaucguguccuaugauugggacuucggagacggcgccacaagcagagggaagaacuccguucacgcuuacaaaaaggcgggcaccuacaaugugacacugaaggucaccgaugacaaaggagccacggcuacagaaucuuuuaccauugagaucaagaacgaagauaccacaacccccauuacaaaagagauggagcccaaugacgauaucaaggaagccaacggcccuauuguggaggggguuacggugaaaggagaccugaacggcagcgaugacgccgauaccuucuauuuugacgucaaggaagauggggacgugacaaucgagcuuccguacuccggaucuagcaauuucaccuggcucguguauaaggagggcgacgaucagaaccacaucgcuuccgggauugacaaaaauaacucuaaggucggcacauuuaaaagcaccaagggacgccauuacguuuucaucuauaaacacgauuccgccagcaauauuucuuacucccugaacaucaagggccuggggaaugaaaagcucaaagagaaggaaaacaaugacagcucugauaaagcgacggugauucccaacuuuaauaccacaaugcagggaucccugcuuggcgacgauagccgggacuauuacucuuucgaggugaaggaagagggggaggucaacaucgaacuggauaaaaaggacgaguucggagugaccuggacacuccauccugaauccaauaucaacgauagaauuaccuacggccaaguugacggcaauaaggugagcaacaaagucaagcugcgccccgggaaauauuaccugcuuguguauaaguacuccggaagcggcaauuaugagcuccggguuaacaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6693 - RNA, 3357 nt, Artificial Sequence
  mRNA product Design5 comprising derived and/or modified sequence from Clostridium histolyticum__BAA77453.1__HsALB(1-18)_ColG(111-1118) (opt5)
gggagagucccgcagucggcguccagcggcucugcuuguucgugugugugucguugcaggccuuauucaagcuuaccaugaagugggugaccuucaucagccugcucuuucuguucuccucugccuacagcauugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6694 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt5)
gggagagucccgcagucggcguccagcggcucugcuuguucgugugugugucguugcaggccuuauucaagcuuaccaugaagugggugaccuucaucagccugcucuuucuguucuccucugccuacagcaugaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6695 - RNA, 3381 nt, Artificial Sequence
  mRNA product Design5 comprising derived and/or modified sequence from Clostridium histolyticum__BAA34542.1__ColH (opt5)
gggagagucccgcagucggcguccagcggcucugcuuguucgugugugugucguugcaggccuuauucaagcuuaccaugaacuuccugaagaucauucucaauagaggcaaaaccaugaagcggaaaugccugagcaagcgccuuaugcuggccaucacaauggcuacgauuuuuaccgugaacuccacacuccccaucuacgccgcggucgacaaaaauaacgcuaccgccgccguucagaaugagucuaagagauauacagugagcuaccugaagacccuuaacuauuacgaucugguggaccuccuggucaaaacagaaauugagaaucugccugaucucuuccaauauuccucugacgcuaaggaauuuuacgggaacaaaacccggaugagcuucaucauggaugagaucggacgcagagccccgcaguauacggaaauugaccacaagggcauccccacccugguggagguugugcgggcuggguuuuaccuuggauuccauaauaaagagcugaacgaaauuaauaagcgcuccuuuaaggagagagucaucccuucuauucucgccauccagaaaaaccccaauuucaagcugggcacagaagugcaggauaaaauuguuagcgcgaccgggcuucuggccggaaacgagacagcuccucccgagguggucaauaacuuuaccccuauccuccaagacuguaucaagaacauugaucgguacgcccuggacgaucugaaauccaaggcucucuucaaugugcuggccgcgccgacguaugacaucacagaauaccuucgcgccaccaaagagaagcccgaaaacacaccuugguauggcaagauugauggcuuuaucaaugagcugaaaaagcucgcucuguacgggaaaauuaacgacaauaacagcuggaucaucgacaauggaauuuaucacaucgcuccccuuggcaagcugcauucuaacaauaaaauugggaucgaaacccucaccgaggugaugaaggucuacccuuaucuguccaugcagcaccuucagagcgccgaucagauuaagagacauuacgacucuaaagaugccgagggaaacaagaucccccucgacaaauucaagaaagaaggcaaggagaaguacugcccgaaaacauauacguuugaugacgggaagguuaucauuaaagccggagcucggguggaagaggaaaaggugaaacgccuguacugggcguccaaggaggucaauagccaauucuucagaguguauggcaucgauaagccucuugaggaaggcaaccccgacgauauucugaccaugguuaucuacaauucuccugaggaauauaaacucaacuccgugcuguacggguaugacacaaauaacggaggcauguacauugagcccgaagggaccuuuuucacauacgagcgggaggcccaggaaagcaccuauacgcuugaggaacuguuucgccacgaguacacacacuaucuccagggaagauacgcuguccccggccagugggggcggaccaagcuguaugauaacgacagacugaccugguacgaggaaggaggcgccgaacucuucgccggcuccacacgcaccucugggauccugccucggaaaagcauuguguccaauauccauaacacaacgagaaauaaccgcuauaagcugagcgacaccguucacucuaaauacggagcuuccuuugaguucuacaauuaugccuguauguuuauggauuacauguauaacaaggacaugggcauccugaauaaacucaacgaucuggcgaagaauaacgacguggauggguacgacaauuauauucgggaucugagcucuaacuacgcucuuaaugacaaguaucaagaucauaugcaggagagaaucgacaacuacgaaaaucucacagucccguucguggccgaugacuaccugguccgccacgccuauaaaaaccccaacgagauuuacagcgagaucuccgaaguggcuaagcugaaagaugccaagucugagguuaaaaagagccaguauuuuuccaccuucacacuccggggaagcuacaccggcggggcuucuaagggcaaacuggaagaccaaaaggccaugaauaaauuuauugacgauucccuuaagaaacuggacacguauagcuggucuggauacaagacccucacagcguauuucaccaacuacaagguggauuccagcaauagagucacauacgacgugguuuuucacggcuaucugccuaacgagggggauuccaaaaauucucugcccuacggaaagaucaacggcaccuauaaagggacggaaaaggagaaaaucaaguucagcuccgagggaucuuucgacccugauggcaagauugugagcuacgaaugggacuuuggggauggcaauaaauccaacgaggaaaaucccgagcauagcuaugacaaggucggaacauacaccgugaaacuuaaggugacagaugacaaaggcgaaucuuccguuagcaccaccacagccgagaucaaggaucucucugagaacaaacugccggucauuuauaugcacgugccuaaguccggggcucugaaucagaagguggucuucuacggaaaaggcacguacgaccccgacgggagcaucgccggauaucagugggauuuuggcgacgggucugauuucagcuccgaacagaacccuagccauguguacaccaagaaaggcgaguauacaguuacccuccgcgugauggacucuuccggacaaaugagcgaaaagacaaugaaaauuaagaucaccgaucccgucuacccuaucggcacggagaaggagcccaauaacuccaaagaaacagcuucugggccgauugugccuggaauccccguuagcggcaccauugagaauaccuccgaccaggauuauuuuuacuucgacgugaucacacccggggaagucaagauugauaucaacaaacugggauauggcggggccaccugggugguuuacgacgagaacaauaacgcggugucuuacgccacagaugacggccagaaucuuagcggaaaguuuaaagcugacaagccuggccgguauuacauccaccuguauauguucaacggguccuacaugccguauagaauuaauaucgaaggaucugucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6696 - RNA, 3342 nt, Artificial Sequence
  mRNA product Design5 comprising derived and/or modified sequence from Clostridium histolyticum__BAA34542.1__ColH (opt5)
gggagagucccgcagucggcguccagcggcucugcuuguucgugugugugucguugcaggccuuauucaagcuuaccaugaagagaaaaugccugagcaagcggcucaugcuggccaucaccauggcuacaauuuucacggugaacuccacccuucccaucuacgccgcggucgacaaaaauaacgcuacagccgccguucagaaugagucuaagcgcuauaccgugagcuaccugaaaacacucaacuauuacgaucugguggaccuucuggucaagaccgaaauugagaaucucccugaucuguuucaauauuccucugacgcuaaggaguucuacggcaacaaaacaagaaugagcuuuaucauggaugaaauugggcggcgcgccccgcaguauaccgaaaucgaccacaagggaauccccacgcugguggagguugugagagcuggcuucuaccucggguuucauaauaaagagcugaacgaaauuaauaagcgguccuucaaagagcgcgucaucccuucuauucuugccauccagaagaaccccaauuuuaagcugggaaccgaagugcaggauaaaauuguuagcgcgacaggccuccuggccgggaacgagaccgcuccucccgagguggucaauaacuucacaccuauccuucaagacuguauuaagaauaucgauagauacgcccuggacgaucucaaauccaaggcucuguuuaacgugcuggccgcgccgaccuaugacaucacggaauaccuccgggccacaaaagagaagcccgaaaacaccccuugguauggaaaaauugauggcuucaucaaugagcugaagaaacuugcucuguacggcaagauuaacgacaauaacagcuggaucauugacaaugggaucuaucacaucgcuccccucggaaagcugcauucuaacaauaaaauuggcaucgaaacacuuaccgaggugaugaaggucuacccuuaucuguccaugcagcaccuccagagcgccgaucagauuaaacgccauuacgacucuaaggaugccgaggggaacaagaucccccuggacaaauuuaagaaagaaggaaaggagaaauacugcccgaagaccuauacauucgaugacggcaagguuauuaucaaagccggggcuagaguggaagaggaaaaggugaaacggcuguacugggcguccaaggaggucaauagccaauuuuuccgcguguauggaaucgauaaaccucucgaggaaggcaaccccgacgauauucugacgaugguuaucuacaauucuccugaggaauauaaacuuaacuccgugcuguacggcuaugacaccaauaacgggggaauguacauugagcccgaaggcacauucuuuaccuacgagagagaggcccaggaaagcacauauacccucgaggaacuguuccggcacgaguacacgcacuaucuucaggggcgcuacgcuguccccggacaguggggcagaacaaagcuguaugauaaugaccggcucaccugguacgaggaagggggagccgagcuguuugccggcuccaccagaacaucuggcauccugccucgcaagagcauuguguccaacauccauaacaccacacggaauaacagauauaagcucagcgacacgguucacucuaaauacggggcuuccuucgaauuuuacaauuaugccuguauguucauggauuacauguauaacaaggacaugggcauucugaauaaacuuaacgaucuggcgaagaauaacgacguggauggauacgacaauuauauccgcgaucucagcucuaacuacgcucugaaugacaaauaucaagaucauaugcaggagcggaucgacaacuacgaaaaucugaccgucccguuuguggccgaugacuaccuugucagacacgccuauaagaaccccaaugagauuuacagcgagaucuccgaaguggcuaagcucaaagaugccaagucugagguuaaaaagagccaguauuucuccacauuuacccugcgcgggagcuacacaggaggcgcuucuaaagggaagcuggaagaccaaaaggccaugaacaaauucauugacgauucccucaagaaacuggacaccuauagcuggucuggcuacaagacgcuuaccgcguauuuuacaaacuacaaaguggauuccagcaaucgggucaccuacgacgugguuuuccacggauaucugccuaacgagggcgauuccaaaaauucucuccccuacgggaagaucaacggaacauauaagggcaccgaaaaggagaaaauuaaguuuagcuccgaggggucuuucgacccugauggaaaaaucgugagcuacgaaugggacuucggcgaugggaauaaguccaacgaggaaaaucccgagcauagcuaugacaaggucggcacguacacagugaaacugaaggugaccgaugacaaaggagaaucuuccguuagcacaaccaccgccgagaucaaggaucugucugagaacaaacuuccggucauuuauaugcacgugccuaaguccggcgcucucaaucagaaaguggucuuuuacgggaagggaacauacgaccccgacggcagcaucgccggguaucagugggauuucggagacggcucugauuuuagcuccgaacagaacccuagccauguguacacgaagaaaggggaguauaccguuacacugagagugauggacucuuccggccaaaugagcgaaaagaccaugaaaauuaagaucacagaucccgucuacccuauuggaaccgagaaagagcccaauaacuccaaggaaacggcuucuggcccgaucgugccugggauccccguuagcggaacaauugagaauaccuccgaccaggauuauuucuacuuugacgugaucacccccggcgaagucaagauugauaucaacaaacugggguauggaggcgccacaugggugguuuacgacgagaauaacaacgcggugucuuacgccaccgaugacgggcagaaucucagcggcaaguucaaagcugacaagccuggacgcuauuacauucaccuguauauguuuaacggcuccuacaugccguaucggaucaauaucgaagggucugucggaagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6697 - RNA, 3276 nt, Artificial Sequence
  mRNA product Design5 comprising derived and/or modified sequence from Clostridium histolyticum__BAA34542.1__HsALB(1-18)_ColH(41-1021) (opt5)
gggagagucccgcagucggcguccagcggcucugcuuguucgugugugugucguugcaggccuuauucaagcuuaccaugaagugggugaccuucaucagccugcucuuucuguucuccucugccuacagcguccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6698 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt5)
gggagagucccgcagucggcguccagcggcucugcuuguucgugugugugucguugcaggccuuauucaagcuuaccaugaagugggugaccuucaucagccugcucuuucuguucuccucugccuacagcaugaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6699 - RNA, 852 nt, Artificial Sequence
  mRNA product Design5 comprising derived and/or modified sequence from Homo sapiens__NP_001133.1__HsAMELX (opt5)
gggagagucccgcagucggcguccagcggcucugcuuguucgugugugugucguugcaggccuuauucaagcuuaccaugggcaccuggauccuguucgccugccuccugggggcugccuuugcgaugccccuuccuccgcaccccggacauccuggcuacauuaacuucagcuaugaggugcugacaccccucaagugguaccaguccaucagaccucccuauccuucuuacggguaugaaccgaugggaggcuggcugcaccaucaaauuauccccguccuuagccagcagcacccucccacgcauacccugcagccucaccaccauauucccguugugccggcucaacagccugugaucccccagcagccuaugaugcccguccccgggcaacacuccaugacaccuauccagcaucaccagccgaaucugcccccucccgcccagcaaccuuaccagccccagccggugcaaccucagccccaccagccuaugcagccccaaccucccguucauccgaugcagccucucccuccccagcccccgcugcccccuauguuucccaugcagccucugcccccuaugcuccccgaccuuacccuggaggccuggccgucuacagauaaaaccaagcgggaagagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6700 - RNA, 411 nt, Artificial Sequence
  mRNA product Design5 comprising derived and/or modified sequence from Homo sapiens__NP_001133.1__HsAMELX-TRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucaccccucugaagugguaccaguccauuagaccucccuaucccucuuacggauaugaaccgaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6701 - RNA, 444 nt, Artificial Sequence
  mRNA product Design5 comprising derived and/or modified sequence from Homo sapiens__NP_001133.1__HsAMELX-LRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucacaccccugaagugguaccaguccauuagaccucccccuaugcuuccggaccugacccucgaagccuggcccucuacggauaaaaccaagcgggaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6702 - RNA, 483 nt, Artificial Sequence
  mRNA product Design5 comprising derived and/or modified sequence from Homo sapiens__NP_001133.1__HLA-A2-SP_HsAMELX(17-60) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuauucggcccccuuauccgagcuacggcuaugaacccaugggaggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6703 - RNA, 516 nt, Artificial Sequence
  mRNA product Design5 comprising derived and/or modified sequence from Homo sapiens__NP_001133.1__HLA-A2-SP_HsAMELX(17-47,168-191) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuauucggcccccuccgaugcuccccgaccugacacuggaagccuggccuagcaccgauaaaacaaagcgcgaggaaguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6704 - RNA, 855 nt, Artificial Sequence
  mRNA product Design5 comprising derived and/or modified sequence from Homo sapiens__NP_001134.1__HsAMELY (opt5)
gggagagucccgcagucggcguccagcggcucugcuuguucgugugugugucguugcaggccuuauucaagcuuaccaugggcaccuggauccuguucgccugccucgugggggcugccuuugcgaugccccugccuccgcaccccggacauccuggcuacauuaacuucagcuaugagguccuuacaccccugaagugguaccaguccaugaucagaccucccuauucuagcuacggguaugaaccuaugggaggcuggcuccaccaucaaauuaucccgguugugucccagcagcacccccugacgcauacccuucagucucaccaccauauuccugugguccccgcucaacagccucgggugcgccagcaggcccugaugcccguuccggggcaacagagcaugacaccuacccagcaccaucagcccaaucucccucugcccgcccaacagcccuuucagccucaaccggugcagccccagccucaccagcccaugcaaccucagcccccgguccagccuaugcagccccugcucccucaacccccucugcccccgauguucccucuuagaccccugcccccuauccucccggaccugcaccuugaggcuuggcccgccacagauaaaaccaagcaggaagagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6705 - RNA, 414 nt, Artificial Sequence
  mRNA product Design5 comprising derived and/or modified sequence from Homo sapiens__NP_001134.1__HsAMELY-TRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucaccccucugaagugguaccaguccaugauuagaccucccuauucuagcuacggauaugaacccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6706 - RNA, 447 nt, Artificial Sequence
  mRNA product Design5 comprising derived and/or modified sequence from Homo sapiens__NP_001134.1__HsAMELY-LRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucacaccccugaagugguaccaguccaugauuagaccucccccuauccuuccggaccugcaccucgaagccuggcccgcuaccgauaaaacgaagcaagaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6707 - RNA, 486 nt, Artificial Sequence
  mRNA product Design5 comprising derived and/or modified sequence from Homo sapiens__NP_001134.1__HLA-A2-SP_HsAMELY(17-61) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuaugauucggcccccuuauagcuccuacggcuaugaaccgaugggaggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6708 - RNA, 519 nt, Artificial Sequence
  mRNA product Design5 comprising derived and/or modified sequence from Homo sapiens__NP_001134.1__HLA-A2-SP_HsAMELY(17-48,169-192) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuaugauucggcccccuccgauccuccccgaccugcaccuggaagccuggccugccacagauaaaaccaagcaggaggaaguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6709 - RNA, 846 nt, Artificial Sequence
  mRNA product Design5 comprising derived and/or modified sequence from Sus scrofa__NP_999071.1__SsAMELX-001-1 (opt5)
gggagagucccgcagucggcguccagcggcucugcuuguucgugugugugucguugcaggccuuauucaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuuauacgucuuacggguaugaacccaugggaggcuggcugcaucaccaaauuaucccugucguuagccagcagaccccgcagucccaugcgcuucaaccccaccaccauauuccuauggugcccgcucagcagccugggaucccccagcaaccgaugaugccucugcccggacagcacucuaugacaccuacccagcaucaccagcccaaccucccccugccugcccaacagccguuucagccccaaccugugcagccccagccucaccagccccugcaaccgcagagcccuaugcaucccauccagccucuccugccccagccuccccuuccgccuauguucuccaugcaaucucugcuccccgaccugccccuugaggccuggccugcuacagauaaaaccaagcgggaagaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6710 - RNA, 414 nt, Artificial Sequence
  mRNA product Design5 comprising derived and/or modified sequence from Sus scrofa__NP_999071.1__SsAMELX-TRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucacaccccugaagugguaccagaauaugauuagacacccuuauaccuccuacggauaugaacccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6711 - RNA, 447 nt, Artificial Sequence
  mRNA product Design5 comprising derived and/or modified sequence from Sus scrofa__NP_999071.1__SsAMELX-LRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucacaccccugaagugguaccagaauaugauuagacacccuucccuucugcccgaccucccucuggaagccuggccggcuaccgauaaaacgaagcgggaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6712 - RNA, 486 nt, Artificial Sequence
  mRNA product Design5 comprising derived and/or modified sequence from Sus scrofa__NP_999071.1__HLA-A2-SP_SsAMEL(17-61) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaaauaugauucggcaccccuauacaucuuacggcuaugaaccuaugggaggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6713 - RNA, 519 nt, Artificial Sequence
  mRNA product Design5 comprising derived and/or modified sequence from Sus scrofa__NP_999071.1__HLA-A2-SP_SsAMEL(17-49,167-189) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaaauaugauucggcaccccucucuccugccugaccugccgcucgaagccuggcccgccacagauaaaaccaagcgcgaggaaguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6714 - RNA, 810 nt, Artificial Sequence
  mRNA product Design5 comprising derived and/or modified sequence from Sus scrofa__P45561-2__SsAMELX-001-2 (opt5)
gggagagucccgcagucggcguccagcggcucugcuuguucgugugugugucguugcaggccuuauucaagcuuaccaugggcaccuggauccuguucgccugccuccugggggcugccuuuagcaugccccuuccuccgcaccccggacauccuggcuacauuaacuucuccuauaucagacaccccuacacaucuuauggguacgagccuaugggaggcuggcugcaucaccagauuauccccguggucagccaacagacgccucagucccaugcgcuccagccgcaccaccauauucccaugguuccugcucaacagcccgggaucccucagcagcccaugaugccgcugccuggacaacacucuaugacccccacacagcaucaccagccuaaucuuccccugcccgcccagcaaccuuuucagccgcagcccgugcaaccucagccccaccagccucuccagccccaaagcccgaugcauccuauccagccccugcugccucagcccccucugcccccgauguucuccaugcagucucuccuuccugaccugccccucgaagccuggcccgcuaccgauaagacaaaacgggaggaaguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6715 - RNA, 846 nt, Artificial Sequence
  mRNA product Design5 comprising derived and/or modified sequence from Sus scrofa__NP_998965.1__SsAMELX-001-3 (opt5)
gggagagucccgcagucggcguccagcggcucugcuuguucgugugugugucguugcaggccuuauucaagcuuaccaugggcaccuggaucuucuuugccugccugcucggggcuagccuggccaugccccuuccuccgcaccccggacauccuggcuacauuaacuucuccuaugaggugcugacaccccucaagugguaccagaauaugaucagacacccuuauacgucuuacggguaugaacccaugggaggcuggcugcaucaccaaauuaucccugucguuagccagcagaccccgcagucccaugcgcuucaaccccaccaccauauuccuauggugcccgcucagcagccugggaucccccagcaaccgaugaugccucugcccggacagcacucuaugacaccuacccagcaucaccagcccaaccucccccugccugcccaacagccguuucagccccaaccugugcagccccagccucaccagccccugcaaccgcagagcccuaugcaucccauccagccucuccugccccagccuccccuuccgccuauguucuccaugcaaucucugcuccccgaccugccccuugaggccuggccugcuacagauaaaaccaagcgggaagaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6716 - RNA, 495 nt, Artificial Sequence
  mRNA product Design5 comprising derived and/or modified sequence from Sus scrofa__K7GPB2__SsAMELX-002 (opt5)
gggagagucccgcagucggcguccagcggcucugcuuguucgugugugugucguugcaggccuuauucaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuucucugcuucccgaccugccucucgaagcguggccggcuacggauaaaaccaagcgggaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6717 - RNA, 888 nt, Artificial Sequence
  mRNA product Design5 comprising derived and/or modified sequence from Sus scrofa__K7GLD0__SsAMELX-003 (opt5)
gggagagucccgcagucggcguccagcggcucugcuuguucgugugugugucguugcaggccuuauucaagcuuaccaugggcaccuggauccuguucgccugccuccugggggcugccuuuagcaugccccuuccuccgcaccccggacauccuggcuacauuaacuucuccuaugaggaccuguaccucgaagcgaucagaauugaucggacagcuuuugugcugacgccccuuaagugguaucagaauaugauccgccacccuuacaccucuuauggguacgagcccaugggaggcuggcugcaucaccaaauuaucccugucguuagccagcagacaccgcagucccaugcccuccaaccccaccaccauaucccuauggugcccgcccagcagccugggauuccccagcaaccgaugaugccucugcccggacagcacucuaugaccccuacacagcaucaccagcccaaccugccccucccugcucaacagccguuccagccccaaccugugcagccccagccucaccagccccugcaaccgcagagcccuaugcaucccauccagccucuucugccccagccuccccucccgccuauguuuuccaugcaaucucugcuucccgaccugccccucgaagccuggccugcuaccgauaaaacaaagagagaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6718 - RNA, 774 nt, Artificial Sequence
  mRNA product Design5 comprising derived and/or modified sequence from Sus scrofa__K7GPE9__SsAMELX-004 (opt5)
gggagagucccgcagucggcguccagcggcucugcuuguucgugugugugucguugcaggccuuauucaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuacgccccaaucucaugcgcugcagccucaccaucacauuccgaugguccccgcucagcagccugggaucccccaacagccuaugaugccccuuccgggacagcacagcaugaccccuacacagcaucaccaacccaaccugccucuccccgcccagcagcccuuucagccucaaccgguucagccccagccucaucaaccccugcagccucagucccccaugcacccgauucagccucugcucccccaaccuccccugccucccauguucucuaugcagagccuucugccggaccucccucuggaagccuggcccgcuaccgauaaaacaaagcgggaggaaguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6719 - RNA, 798 nt, Artificial Sequence
  mRNA product Design5 comprising derived and/or modified sequence from Sus scrofa__J9JIM4__SsAMELX-201 (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucacaccccugaagugguaccagaauaugauuagacacccuuauaccuccuacggauaugaacccaugggcggguggcuucaucaccaaaucauuccugucguuucucagcagacgccgcagagccaugcccugcaaccccaccaccauaucccuauggugcccgcucagcagccuggcauuccccagcaaccgaugaugccucuccccggacagcacuccaugaccccuacacagcaucaccagcccaaccugccccuuccugcccaacagccguuucagccccaaccugugcagccccagccucaccagccccugcaaccgcagucuccuaugcaucccauccagccucuccugccccagccuccccugccgccuauguucagcaugcaaucccuccugcccgaccuuccccuggaggcguggccugcuaccgauaaaacaaagcgggaagaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6720 - RNA, 3237 nt, Artificial Sequence
  mRNA product Design5 comprising derived and/or modified sequence from Homo sapiens__NP_006120.1__HsBMP1 (opt5)
gggagagucccgcagucggcguccagcggcucugcuuguucgugugugugucguugcaggccuuauucaagcuuaccaugcccggcguggccagacugccucuccugcuugggcugcuccugcuuccgcggcccggacgcccucuggaccucgcugauuacaccuaugaccuggccgaggaagaugacagcgagccccugaacuacaaggauccuugcaaagcggcugccuuccucggcgacaucgcccuggaugaagaggaccuuagagcuuuucagguccaacaggccguugaucugcggcgccacacagcuagaaaguccucuauuaaagccgcggugcccgggaauacgagcaccccuuccugucagucuacaaacggacagccgcaacggggcgccugcgggcgcuggagaggacggagccgcuccagacgggcugccaccucucgccccgaaagaguguggccugacggcgucauccccuucgugauuggcgggaauuuuacaggaagccagcgggcuguuuuccgccaggccaugagacauugggagaagcacaccugugugacauuucucgagcggaccgaugaagacuccuauaucgucuucacguacagaccuugcggcuguugcagcuauguggggcgccggggaggcgggccccaggcgauuucuaucggaaagaacugugauaaguuuggcaucguugugcaugagcugggccacgucgugggguucuggcaugaacacaccagaccggaccgcgaccggcacguguccauugucagagagaauauccaaccuggacaggaguacaacuuucuuaagauggaaccccaggagguugaaagccugggcgagacauaugauuucgacucuauuaugcauuacgcccgcaauaccuuuucccgggggaucuuccucgauacaauugugccuaaauacgaagugaacggagucaagccucccaucggccagagaacccgccugagcaaaggggacauugcucaagcccggaagcuguauaaaugccccgcuuguggagagacgcuccaggauucuacaggcaauuuuuccagcccggaguaccccaacggcuauuccgcccacaugcauugcguguggagaaucucuguuaccccuggggaaaagaucauucugaauuucacaagccuugaccuguaccgcucccggcucuguugguaugauuacguggaggucagagacggauucuggcggaaggcuccccugcgcggcagauuuugcgggagcaaacuuccugaacccaucgugucuaccgauucccggcuguggguugaguucagaagcucuagcaacugggugggaaagggcuuuuucgccgucuaugaagcgauuugcgggggcgacgugaaaaaggauuacggacacauccaguccccgaauuacccugacgacuaucgccccucuaaagucuguauuuggcggauccaagugagcgagggcuuucacguugggcucaccuuccaguccuuugagaucgaaagacaugauagcugcgccuacgacuaucuggaggugcgcgauggacacucugaauccagcacacugauuggcagauacuguggguaugagaagccugacgauaucaaaucuacguccagccggcucuggcugaaguucgucuccgacggaucuauuaacaaggcuggcuuugccgugaauuucuuuaaagaaguugaugagugcagccgccccaacagagggggcugugagcagcggugccuuaacacccugggauccuacaaguguucuugcgacccuggcuaugaacucgcccccgauaaacgcagaugugaggcugccugcgggggauuccugacaaaacuuaauggcagcaucaccuccccgggguggccuaaagaauacccucccaacaagaauuguauuuggcagcugguggcgcccacacaauaccggaucagccuccaguuugacuucuucgagaccgagggaaacgaugucugcaaguaugacuuuguggaagugcgcucuggccugacggcugauuccaaacugcaugggaaguucugcggcagcgagaaaccggaaguuaucacaucucaguacaauaacaugagagucgaguuuaaguccgacaauaccgugagcaaaaagggauucaaggcccacuuuuucucugacaaagaugaauguagcaaggacaacggcgggugccagcaagauugugugaauaccuuuggauccuaugagugccagugucggagcggcuucguccuccaugacaacaaacacgauugcaaggaggccgggugugaccacaaagugacaucuaccuccggaacaauuacgagccccaauuggccugauaaguaccccuccaagaaagaaugcaccugggcuaucucuagcacaccuggccaucgcguuaagcugaccuuuauggagauggacauugaaucccagcccgagugugccuaugaucaccuugaaguguucgacgggagagaugcuaaagccccuguccugggccgguuuugcggaucuaagaaacccgagccggugcucgcgacaggcagcagaauguuccugcgcuuuuacuccgacaacucuguucagcggaagggguuccaagccagccaugcuaccgaguguggaggccaggugagagccgaugucaaaacgaaggaccuguauucccacgcucaguucggggacaauaacuacccuggaggcguggauugcgaauggguuaucguggccgaggaaggcuacggggucgagcuuguguuucagaccuucgaaguggaggaggaaacagacugcggauaugauuacauggagcucuuugacggcuaugauagcaccgcgccccgccuggggcgguacuguggaucuggcccucccgaagaggucuauuccgccggggacagcguucuggugaaguuccacucugaugacacaauuaccaaaaagggauuucaucucagauacacguccacaaaauuccaagauacccugcacagccgcaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6721 - RNA, 1467 nt, Artificial Sequence
  mRNA product Design5 comprising derived and/or modified sequence from Homo sapiens__NP_001191.1__HsBMP2 (opt5)
gggagagucccgcagucggcguccagcggcucugcuuguucgugugugugucguugcaggccuuauucaagcuuaccaugguggccggcaccagaugccugcucgcucugcuucugccccagguccuccuugggggagccgcgggccugguuccugagcuggggcggcgcaaguucgcugccgccagcuccggaagaccgucuagccaacccuccgacgaagugcucucugaguuugaacugcggcugcucagcauguucggccugaaacagcgcccuacacccuccagagaugcuguggucccucccuacaugcuugaccuguaucggcgccacucugggcagccuggaagcccggcccccgaucauagacucgagcgggcugccucccgcgcgaacacggugagaucuuuucaccaugaagagucucuggaggaacuuccugagaccuccggcaagacaacccggcgcuucuuuuucaaucugagcucuauccccacagaagaguuuauuaccuccgccgagcuccagguuuucagagaacaaaugcaggacgcucugggcaacaauagcucuuuucaccaucggaucaacauuuacgagaucauuaaaccugccacagcuaauuccaaguuccccgugacccgccugcucgauacgagacuggucaaccagaaugccagccggugggaauccuuugacgugaccccggcgguuaugagauggacagcccaggggcacgcuaaccacggauucguggucgagguggcccaucuugaagagaaacaaggcgugucuaagcgccacguccggaucagcagaucccugcaucaggaugagcacagcuggucucagauccgcccucuccugguuaccuuugggcacgacggaaagggccauccccuucacaaacgggaaaagagacaggcuaaacauaagcaacgcaaacggcugaaguccagcuguaagagacacccucucuauguggauuucucugacgugggguggaaugauuggauugucgccccucccggauaccaugccuucuauugccacggcgagugucccuuuccgcuggcugaccaccugaacagcacaaaucaugcgaucgugcagacccucguuaacuccgugaauagcaaaauucccaaggccugcugugucccuacggaacugagcgcuaucuccaugcuuuaccuggaugagaacgaaaaagugguucucaagaauuaucaggacaugguggucgagggcugcgggugucgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6722 - RNA, 1503 nt, Artificial Sequence
  mRNA product Design5 comprising derived and/or modified sequence from Homo sapiens__NP_001193.2__HsBMP4 (opt5)
gggagagucccgcagucggcguccagcggcucugcuuguucgugugugugucguugcaggccuuauucaagcuuaccaugauccccggcaacagaaugcugauggugguccuccugugccagguucuucucgggggagccagccacgcuucccugauuccugagaccggcaagaaaaagguggccgaaauccaagggcaugcgggaggccggcgcucugggcagagccacgagcugcuuagagacuucgaagcuacacugcuccagauguuuggacugcggcgcagaccgcagcccuccaaaucugccgugauuccugauuacaugcgggaccuguaucgccuccaaagcggcgaggaagaggaggaacagauccauuccacgggccuggaguaccccgaaagaccugccucucgggcuaauaccguccgcagcuuccaccaugaggagcaccuugaaaacauucccgggacauccgagaauagcgccuuuagauuccuguuuaaccucucuuccaucccugaaaaugaggugaucagcucugcugaacugcggcuuuuccgcgagcagguugaucagggaccggacugggagagaggcuuucaccggauuaacaucuaugaagugaugaagcccccugccgaggucgugcccgggcaucugauuacccgccuccuggauacaagacugguucaccauaaugugacccggugggaaacauucgacgucuccccugcggugcucagauggacccgcgagaaacaacccaacuacggacuggccaucgaagugacgcaccuucaccagacccggacacaucagggccagcacgucagaauuagccgcucucugccgcaaggguccggaaauugggcucagcuccggccucugcuuguuaccuuuggccaugauggcagagggcacgcccugacacgccggagacgcgcuaagcggagccccaagcaucacucccagagagcccgcaaaaagaacaaaaauugucggagacacucucucuauguggacuucagcgaugugggauggaacgacuggaucgucgcgccucccggcuaccaagccuuuuauugccauggggauugucccuucccucuggcugaccaccucaauuccaccaaccaugccauugugcagacgcugguuaauagcgugaacucuuccaucccgaaggcuugcuguguccccacagagcugagcgccaucucuaugcuuuaccuggaugaguacgacaaagugguucucaagaacuaucaggaaaugguggucgagggaugcggcugucggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6723 - RNA, 1818 nt, Artificial Sequence
  mRNA product Design5 comprising derived and/or modified sequence from Homo sapiens__NP_001709.1__HsBMP6 (opt5)
gggagagucccgcagucggcguccagcggcucugcuuguucgugugugugucguugcaggccuuauucaagcuuaccaugcccggccuggggagacgggcccaguggcucugcuggugguggggacugcuuuguagcugcuguggcccuccgccccugcgcccuccccucccugcugccgcggcugccgccgcugggggacaacugcuuggcgacgggggaucccccggcagaaccgagcagccuccgcccucuccucagagcuccucuggcuuccuguaccggcgccucaagacacaggagaaaagagaaaugcaaaaggaaauccugagcgugcuggggcucccccaccggccucgcccccugcauggacuucagcagccgcagccucccgcccugagacaacaggaggaacagcagcaacagcagcaacucccucggggcgagcccccucccgggcgccugaaauccgcuccgcuuuuuaugcuggaucucuauaacgcccugucugcggacaaugaugaggacggagccagcgaaggcgagagacagcaguccuggccccacgaagcugccuccucuucccagcggcgccaaccucccccuggggcugcccauccccugaacagaaagagccuccuggcgccgggaucuggcuccggcggggccagcccucuuacgucugcucaggauuccgccuuccugaaugacgcugauauggucaugagcuuuguuaaccucguggaguacgacaaagaguucagcccccggcagcgccaccauaaggaauuuaaguucaaucugucucagauuccugagggagaaguggucaccgccgccgaguuuagaaucuauaaagauugcgugaugggcagcuucaagaaccaaacauuucuuauuuccaucuaccagguucugcaggaacaccagcaccgggacagcgaucucuuccugcuggacaccagaguggucugggcuucugaggagggguggcucgaauuugauauuacagcgaccuccaaucugugggugguuacaccccaacauaacaugggacuucagcugagcguggucacccgcgacggcgugcacgugcauccucgggccgcugggcucgucggaagagacggccccuaugauaaacagccguucaugguugccuuuuucaaggugucugaggugcacguccgcacgacccggagcgccuccucuagacgccggcagcaaagcagaaaucgcuccacacagagccaggacguggcucggguuucuuccgccagcgauuacaacucuuccgaacugaaaaccgcguguagaaagcacgagcuuuaugugagcuuccaagaccugggcuggcaggauuggaucaucgcuccuaagggguacgccgccaauuacugcgacggagaauguuccuuuccccucaacgcucauaugaaugccacaaaccacgcuauuguccagacccuggugcaucugaugaaucccgaguauguuccuaaaccgugcugugcccccacgaagcucaacgcgaucucugugcuguacuucgaugacaacagcaaugucauucuuaaaaaguaucgcaacauggugguccgggccugcggcugucacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6724 - RNA, 1572 nt, Artificial Sequence
  mRNA product Design5 comprising derived and/or modified sequence from Homo sapiens__NP_001710.1__HsBMP7 (opt5)
gggagagucccgcagucggcguccagcggcucugcuuguucgugugugugucguugcaggccuuauucaagcuuaccaugcacgugagaagccugcgggccgcugcuccccauuccuucgucgcgcucugggcuccucuguuucuucugcgcucugcccucgccgacuucagccuggauaacgagguucacuccucuuuuauccauagacggcuucgcagccaggaaagacgggagaugcaacgcgaaauucuguccauccucggccugccgcacagaccccggccucaucugcaggggaagcacaauucugcucccauguucaugcucgaccuguacaacgccauggcuguggaggaaggaggcgggccuggaggccagggguuuagcuaucccuacaaagccguguucuccacccagggaccuccgcuugcgagccugcaagauucucacuuucucacagacgccgauauggucauguccuucgugaaucugguugagcaugacaaggaguuuuuccacccccgcuaucaucacagagaauuucgguucgaucuuagcaaaauuccugagggcgaagcugugacggccgcugaguuucgcaucuacaaggacuauauuagagagcgguucgauaacgaaaccuuccgcaucucugucuaccaggugcugcaggagcaccucggcagagaauccgaccuguuucugcucgauagccggacacugugggccucugaggaaggguggcuuguuuucgacaucaccgcgacauccaaucauuggguggucaaccccagacacaaucugggacuccagcugagcguggagacccuugauggccaauccauuaacccuaaacuggccgggcucaucggacgccauggcccccagaauaagcagccguuuaugguggcuuucuuuaaggccacagagguccacuuccggucuauuagaagcaccggguccaaacagcgcagccaaaaccggucuaagacgccuaaaaaucaggaagcucugagaauggccaacguugccgaaaauuccagcucugaccagcgccaagccugcaagaaacaugagcuguaugugagcuuucgggaccucggauggcaggauuggaucauugcgcccgagggcuacgccgcuuacuauugugaaggcgagugcgccuucccucugaacuccuacaugaaugccaccaaccacgcuaucgugcagacacuuguccacuuuauuaaccccgagaccgugcccaagccuuguugcgccccgacacagcugaaugcgaucucuguucucuauuucgacgauagcuccaacgugauccugaagaaauacagaaauauggucgugcgcgcuugugggugccauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6725 - RNA, 576 nt, Artificial Sequence
  mRNA product Design5 comprising derived and/or modified sequence from Homo sapiens__NP_006264.2__HsCCL7 (opt5)
gggagagucccgcagucggcguccagcggcucugcuuguucgugugugugucguugcaggccuuauucaagcuuaccaugaaggccagcgcugcccugcucugccugcuucugaccgcggcugccuucucuccccagggccucgcccaaccuguggggaucaacacauccacgaccuguugcuacagauuuauuaauaaaaagaucccgaaacagcggcuggagagcuaucgcagaacaaccuccucucacuguccccgggaagcugucauuuucaagacaaaacuugacaaggagaucugcgccgauccuacccagaaguggguucaggacuuuaugaaacaucuggauaagaaaacacaaacccccaagcucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6726 - RNA, 3900 nt, Artificial Sequence
  mRNA product Design5 comprising derived and/or modified sequence from Homo sapiens__NP_001954.2__HsEGF (opt5)
gggagagucccgcagucggcguccagcggcucugcuuguucgugugugugucguugcaggccuuauucaagcuuaccaugcugcucacccugaucauucuucugcccguggucagcaaguucuccuuuguuucucucagcgccccucagcacugguccugcccggagggcacacuggcugggaacggaaauucuacgugugugggccccgccccuuuccuuaucuuuagccaugggaacuccauuuucagaaucgacaccgaaggaacaaauuacgagcaacugguggucgaugcgggcgugucuguuauuauggacuuucacuauaacgaaaaacggaucuacuggguggaucucgagcgccagcugcugcagagagucuuccucaaugggagccggcaggaacgcgugugcaacaucgagaagaauguuuccggaauggcuauuaacuggaucaaugaggaagugauuuggagcaaccaacaggagggcaucauuaccgucacagacaugaaaggcaauaacucucauauccugcuuuccgcccugaaguaucccgccaauguggcuguggauccugucgaaagauuuauuuucuggagcucugagguugccgggucccucuaccgggcugaccuggauggagugggcgugaaagcccuucuggagaccagcgaaaagaucacagcggucucucucgacgugcuggauaagcgccuguuuuggauccaguauaacagagagggguccaauagccucauuuguuccugcgacuacgauggaggcucuguucacaucagcaaacaucccacccagcacaaccuguucgccaugucccuuuuuggggaccggauuuucuauagcacguggaagaugaaaaccaucuggauugcuaacaagcacacaggaaaagauauggugcgcaucaaucugcauucuuccuuugucccucucggcgaacugaaggugguucacccgcuugcccaacccaaggcugaggacgacaccugggaaccugagcagaaacuguguaagcucagaaaaggcaacugcagcucuacagugugugggcaggaucugcagagccaucugugcaugugugccgagggauacgcgcucucccgggaccgcaaguacugcgaagaugucaaugagugugccuucuggaaccacggcugcacccuggggugcaaaaauacgcccggaucuuauuacuguacaugcccugugggcuucguccuucugcccgacgggaagagaugucaccaacucgugagcugcccgcggaacguuuccgaauguagccaugauugcgugcugaccucugagggaccucuuuguuuuugccccgaaggcuccguccuggagcgcgacggcaaaacauguagcggguguucuuccccugauaauggaggcugcagccagcucugcgugccccugucccccguuucuugggagugcgacuguuucccuggguaugaucugcagcucgacgaaaagagcugcgcugccuccggaccgcaacccuuucugcuuuucgcuaacucucaggauaucagacacaugcauuuugacggcaccgacuacgggacccugcucagccagcagaugggcaugguguaugcccuggaucacgacccugucgagaauaagauuuacuucgcccauacagcucugaaauggaucgaacgggcgaacauggauggaucccaaagagagcgccuuauugaagagggcguggacgugcccgaggggcucgccguugauuggaucggacggagauuuuauuggacggaccgcggcaagagccugauugggcggucugaucugaauggaaaaagauccaagaucaucaccaaagaaaacauuagccagccucgcggcaucgcuguccaccccauggccaagcggcuuuucuggacagacaccgggauuaauccgagaaucgagucuuccagccugcagggccuuggacgccuggugauugccucuagcgaucucaucuggccuuccggcauuacaaucgacuuucugaccgauaagcuguacuggugugacgcuaaacagagcgugaucgaaauggccaaccuugaugggucuaagcggagacgccucacgcaaaaugacgucggacaccccuucgcgguggcuguuuuugaggacuacgugugguucuccgauugggccaugccuagcgucaugcgggugaacaaaagaacaggcaaggaccggguucgccugcagggguccaugcugaaacccucuagccucguggucgugcauccucuggccaagcccggagcugauccgugccuuuaucagaacggcgggugugagcacauuugcaagaaaagacugggcaccgccugguguuccugccgggaaggauuuaugaaggcuucugacggcaaaaccugucucgcccuggaugggcaucagcugcuugcgggaggcgagguugaccucaagaaucaagugacaccucuggauauccugagcaaaaccagagucuccgaagacaacauuacagagucucagcacaugcucguggccgaaaucauggugagcgaucaggacgauugcgcucccgucggguguuccauguacgcccgcugcauuagcgagggagaggacgcuacgugccagugucugaagggcuucgccggggauggcaagcucugcucugacaucgacgaaugugagaugggaguucccgugugcccuccggcguccagcaaauguaucaauaccgaaggcggguaugugugccgguguucugagggauaccaaggcgaugggauucacugccuggacaucgaugaaugucagcucggagagcauuccugcggcgagaacgccagcuguacaaauaccgaaggcggguauacaugcaugugcgcuggaagacugucugagcccggccugauuuguccugacuccacgcccccuccccaccuucgcgaagaugaccaucacuacagcgucagaaacuccgauagcgagugcccucucucucaugacggguauugucugcacgauggagugugcauguacaucgaagcccuggacaaguacgcuuguaauugcguugugggcuauauuggggagcggugucaguaccgcgaucucaaauggugggagcugagacacgccggacauggccaacagcagaaggucaucgugguugccgugugcgucgugguucuugugaugcugcuccugcugagccuuuggggcgcucacuauuaccggacccagaaacugcucuccaagaaccccaaaaauccguaugaagagucuagccgcgacgucagaucccggcgcccugcggacaccgaagaugggaugucuagcuguccccaaccuugguucguggugaucaaggagcaucaggaccugaagaacggaggccagcccgucgccggggaggauggacaggcugccgacggcuccaugcaaccgacaucuuggagacaggaaccucagcucugcgggaugggaaccgagcagggcuguuggauucccguuagcuccgauaaaggcagcugcccucaagugauggaacggucuuuucacaugcccuccuacgggacacagacccuggagggaggcguggaaaagccccauagccuucugucugccaauccucucuggcagcaacgcgcucuggacccgccccaccagauggagcugacgcagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6727 - RNA, 786 nt, Artificial Sequence
  mRNA product Design5 comprising derived and/or modified sequence from Homo sapiens__NP_001423.1__HsEREG (opt5)
gggagagucccgcagucggcguccagcggcucugcuuguucgugugugugucguugcaggccuuauucaagcuuaccaugaccgccggcagacggauggagaugcugugcgcugggcgcgugcccgcccuccugcuuugucugggauuccaccuccugcaggcgguccuuagcacaacgguuaucccuuccugcauuccgggcgaaucuagcgacaacuguaccgcucuggugcaaacagaggauaaucccagaguggcccaggucuccaucaccaagugcucuagcgacaugaacggguacugucuccauggacagugcauuuaucugguggauaugucccagaauuacugucggugcgaaguuggcuauacaggggugcgcugugagcacuuuuuccugaccguccaucaaccucucucuaaagaauacguggcccugacaguuauccuuauuauccuguuucucaucaccguggucggaagcacguauuacuucugcagaugguaucggaaccgcaaguccaaagagcccaagaaagaguacgaaagagugaccagcggcgacccugagcugccccaggugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6728 - RNA, 744 nt, Artificial Sequence
  mRNA product Design5 comprising derived and/or modified sequence from Homo sapiens__NP_000791.1__HsFGF1 (opt5)
gggagagucccgcagucggcguccagcggcucugcuuguucgugugugugucguugcaggccuuauucaagcuuaccauggccgagggcgaaaucaccacauucacggcucugaccgagaaguuuaaccugcccccugggaauuacaaaaagccgaaacuccuuuauugcagcaacggaggccacuuccugcggauucuccccgacgggacaguggauggaaccagagaccgcuccgaucagcauauccaacugcagcuuucugccgaaagcgucggcgagguuuacauuaaguccacagaaaccgggcaguaucuggcgauggacacagauggacuccuguacggcucucagaccccuaaugaggagugucuguuucucgaaagacuggaggaaaaccacuauaauacguacaucagcaaaaagcaugcugagaagaacugguucgugggccuuaaaaagaauggguccugcaaacggggaccccgcacccacuauggccaaaaggccauucuguuucucccucugcccgugucuagcgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6729 - RNA, 1143 nt, Artificial Sequence
  mRNA product Design5 comprising derived and/or modified sequence from Homo sapiens__NP_001997.5__HsFGF2 (opt5)
gggagagucccgcagucggcguccagcggcucugcuuguucgugugugugucguugcaggccuuauucaagcuuaccauggugggcgucgggggaggcgacguugaggaugugacccccagaccugggggaugccagaucagcggccgcggggcccggggauguaacggcauuccgggcgcugccgcgugggaagcugcccugcccagacggcgcccuagacggcaccccuccgugaauccucgcucuagagccgcugggagcccccggacacgcggaagacggacggaggaacgcccuuccggcucuagacucggggaccggggacgcggcagagcccugcccgggggacggcuuggcggcagagggcgcggacgggcucccgagagagucggcgggcgcggacggggcagagggaccgccgcgccucgcgccgcucccgccgcucggggaagcagaccuggccccgccggcacaauggcggccggguccaucaccacacugccggcucucccugaagauggaggcucuggggccuucccgccuggacauuuuaaggaccccaaacgccuguacugcaagaacggcggguucuuucuucggauucaccccgauggcagaguggacggaguucgcgagaaaagcgauccucauaucaagcugcaacuccaggcugaggaacggggcguggucuccauuaaaggggugugugccaauagauaucuggccaugaaggaggacggacggcugcucgcuagcaagugcguuaccgaugaauguuucuuuuucgagcgccuggagucuaacaauuacaacacauauagaucccggaaauacaccagcugguauguggcgcuuaagagaacgggccaguacaaacuggggucuaagaccggaccgggccagaaagccauccucuuucugcccauguccgcuaagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6730 - RNA, 861 nt, Artificial Sequence
  mRNA product Design5 comprising derived and/or modified sequence from Homo sapiens__NP_002000.1__HsFGF7 (opt5)
gggagagucccgcagucggcguccagcggcucugcuuguucgugugugugucguugcaggccuuauucaagcuuaccaugcacaaguggauccugaccuggauucuccccacacugcuuuacagaagcugcuuccauaucauuugucuggugggcacgaucucccucgccugcaacgacaugaccccugagcagauggcuacaaaugucaacuguucuagcccggaacggcacacccgcuccuaugauuacauggaagggggagacauuagaguucggcgccuguuuugcagaacacaaugguaucuucggaucgauaaacgcggcaaggugaaagggacccaggagaugaagaauaacuacaauaucauggagauuagaacaguggccgucggaaucguggcgauuaaaggcguugaaucugaguucuaucuggcuaugaacaaggaggggaagcucuacgccaaaaaggaauguaaugaggacugcaacuuuaaagaacugauccuggagaaucauuauaacaccuacgccagcgcuaaguggacgcacaauggaggcgagauguucguggcccucaaccagaaaggcauucccguccgggggaagaagaccaaaaaggaacagaaaacagcucauuuucugccuauggccaucaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6731 - RNA, 903 nt, Artificial Sequence
  mRNA product Design5 comprising derived and/or modified sequence from Homo sapiens__NP_001936.1__HsHBEGF (opt5)
gggagagucccgcagucggcguccagcggcucugcuuguucgugugugugucguugcaggccuuauucaagcuuaccaugaagcugcuccccagcgugguccugaaacuuuuccuggccgcuguucucuccgcccuggugaccggcgagucucuugaaagacugcggcgcgggcucgcggcuggaacaagcaacccugacccgcccacgguguccaccgaucagcugcugccucucggcgggggaagagaccggaagguccgcgaucugcaagaggccgaccuugaucugcucagagugacacugucuagcaaaccccaggcccuugcuaccccuaauaaggaggaacacggcaaacggaagaagaaagggaagggacugggcaaaaagcgcgaccccugccucagaaaauacaaggauuuuuguauccauggcgaaugcaaguauguuaaagagcugcgggccccuuccuguauuugccacccgggguaccauggagagcgcugucacggccugucucuccccguggaaaacagacuguauacauacgaccauaccacaauccuugcugucguggccguugugcugagcuccgucugccuccuggugauuguggggcuucugauguuccgguaucaccgcagaggaggcuacgaugucgagaaugaagagaagguuaaacucgggaugaccaacagccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6732 - RNA, 2463 nt, Artificial Sequence
  mRNA product Design5 comprising derived and/or modified sequence from Homo sapiens__NP_000592.3__HsHGF (opt5)
gggagagucccgcagucggcguccagcggcucugcuuguucgugugugugucguugcaggccuuauucaagcuuaccaugugggugaccaagcugcuccccgcccugcuucugcagcacguccuccugcaucuucugcuccugccuaucgcuauuccguacgccgagggccaaagaaaacggcgcaacacaauccacgaguucaagaaaagcgcgaagacgacccugauuaaaaucgaccccgcucucaagauuaagaccaaaaagguuaauaccgccgaucagugcgccaacagauguacacggaauaaagggcugccuuuuaccugcaaggcuuucguguuugacaaagcccgcaagcagugucuuugguuccccuuuaacuccaugucuagcggagugaagaaagaguucggccaugaauuugaucuguaugagaauaaggacuacaucagaaacugcaucauugggaaaggacgguccuauaagggcacagucucuaucaccaaaagcgggauuaagugucagccuugguccucuaugaucccccacgaacauagcuuccucccuuccagcuaccgcggaaaagaucugcaagagaauuauugcagaaacccgcggggcgaggaaggcgggcccugguguuuuacgucuaauccugaggugcgcuacgaaguuugcgacauuccccaguguuccgagguggagugcaugaccuguaacggagaaagcuauagaggccuuauggaucacacagagucugggaagaucugccagcggugggaccaccagaccccucaucgccacaaguuccugcccgaaagauacccggauaaaggauuugacgauaauuacugccggaacccugacggccaaccccgcccuugguguuauacacucgauccccauacaagaugggaauacugcgcuauuaagacgugugccgacaauacaaugaacgacaccgaugucccccuggaaacaaccgagugcauccaggggcagggagagggcuaucggggcaccgugaauacaaucuggaacgggauuccuugucagagaugggacucccaauacccgcacgaacacgauaugacgcccgagaacuucaaaugcaaggaccugcgcgaaaauuauugucggaacccugauggaagcgagucucccuggugcuuuaccacagacccuaauaucagaguuggcuacuguucccagauucccaacugcgauaugagccaugggcaggacuguuaucgcggaaauggcaaaaacuacauggggaaucucucccaaacccggucuggacugacaugcagcaugugggauaagaacauggaagaccuucacagacauaucuucugggagccggaugcguccaagcugaaugagaacuacugccgcaauccugacgacgaugcccacggccccugguguuauaccggcaacccucucauucccugggacuacugcccuaucagccggugugaaggggauacgacacccaccaucgugaaucuggaccauccggucauuucuugcgcuaaaaccaagcagcuuagaguggugaacggaaucccuacacgcaccaauauuggcuggauggucucccugcgguauagaaacaaacacaucugugggggaagccucauuaaggagucuuggguucugacagcccgccagugcuuccccagccgggaucugaaagacuacgaggcuuggcucggcauccacgaugugcaugggagaggcgacgaaaaguguaaacaggugcugaacgucucccaacuuguguauggacccgaaggcucugaucugguucucaugaagcuggcccggccugcggugcuugacgauuuugucagcacgaucgaccugccgaauuacgggugcaccauucccgagaagacauccuguagcguguauggauggggcuacaccgggcucaucaacuacgauggacugcugcgcguugcccaccucuauauuaugggcaaugagaaaugcucucagcaucacagagggaaggugacacugaacgaauccgagaucugugcuggcgccgagaaaauuggaagcggcccuugcgaaggggacuacggaggcccccuugucugcgagcagcacaagaugcggauggugcugggggucaucgugccuggaagaggcugugcuauucccaaucgcccugggaucuucguucggguggccuauuacgccaaguggauccauaaaauuauccucaccuauaaggucccccagucuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6733 - RNA, 2202 nt, Artificial Sequence
  mRNA product Design5 comprising derived and/or modified sequence from Homo sapiens__NP_005336.3 __HsHSPA1A (opt5)
gggagagucccgcagucggcguccagcggcucugcuuguucgugugugugucguugcaggccuuauucaagcuuaccauggccaaggcugccgcgaucggcauugaccuggggaccacauacagcugcgugggagucuuccagcacggcaaaguugagaucauugcuaacgaucaagggaauagaacgacccccuccuauguggccuuuacagacaccgaacggcucaucggagaugccgcuaagaaccagguggcccugaauccucagaacacagucuucgacgcuaaacgccuuauuggcagaaaguuuggggauccggugguucagucugacaugaaacauuggcccuuccaagugaucaaugauggagacaagccuaagguccaggugagcuacaaaggcgagaccaaggccuuuuaucccgaagagaucuccucuaugguucugacaaaaaugaaggaaauugcggaggccuaccucggcuauccugugaccaacgcugucaucacggugcccgccuacuucaaugauagccagcggcaggcuaccaaagacgccggggugauugcgggacugaacguccuucgcaucauuaaugagccuacagccgcugccaucgcuuauggccuggauagaaccgggaagggagaacggaacguucucauuuuugaccugggcgggggaacauucgauguguccauccugaccaucgacgacggcauuuuugaggugaaggccacggccggcgauacacaccucgggggagaagacuucgauaaucgccuggucaaccauuuuguggaggaguucaaaagaaagcacaaaaaggacaucucucaaaauaaacgggcuguucgcagacuucggaccgcgugugaacgcgccaagagaacacugagcuccagcacccaggcuucucucgagauugauucccuguuugaaggcaucgacuucuacaccagcauuacacgggcccgcuucgaggaacuuugcucugaucuguuuagauccacgcucgagccgguggagaaagcccugcgggacgcuaagcuggauaaggcccagauccaugaccucguccugguugggggaagcaccagaauccccaaagugcagaaacuucugcaagauuucuuuaacggccgcgaccucaauaagucuauuaacccugacgaagcgguggcuuacggggccgccguccaggcugccauccugaugggagauaaguccgagaacgugcaggaccuucugcuccuggaugucgcuccccugagccucggccuggaaacagccggcggggugaugaccgcgcuuauuaaacggaauagcacaaucccuaccaagcaaacgcagauuuucacaaccuauucugacaaccagcccggaguucugauccagguguacgagggcgaaagagccaugaccaaggauaauaaccuccuggggcgcuuugagcuuagcggaaucccgccugcuccccggggcgucccucaaauugaggugacauucgacaucgaugccaaugggauucugaacguuaccgcuacagacaaauccacgggcaaggccaauaaaaucaccauuacaaacgauaagggaagacucagcaaagaagagaucgaacgcauggugcaggaggcggaaaaguauaaggccgaggacgagguccagcgggaaagagugucugcuaaaaaugcccuggaguccuacgcuuuuaacaugaaguccgccguggaagaugagggccugaaagggaagauuucugaggccgacaaaaagaagguucucgauaaaugucaggaagucaucagcuggcuggacgcuaauacccuugcggagaaggacgaguucgaacacaaacgcaaggaacuggagcaagugugcaaccccaucauuuccggacucuaucagggcgccgggggacccggcccugggggcuuuggagcucagggcccgaaagggggaucuggcagcgggcccacaaucgaggaaguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6734 - RNA, 2202 nt, Artificial Sequence; identical to SEQ ID NO: 6733
  mRNA product Design5 comprising derived and/or modified sequence from Homo sapiens__NP_005337.2 __HsHSPA1B (opt5)

SEQ ID NO: 6735 - RNA, 2202 nt, Artificial Sequence
  mRNA product Design5 comprising derived and/or modified sequence from Homo sapiens__NP_005518.3 __HsHSPA1L (opt5)
gggagagucccgcagucggcguccagcggcucugcuuguucgugugugugucguugcaggccuuauucaagcuuaccauggccaccgcuaagggcaucgccauugggaucgaccugggaacaacguacagcugcgugggcgucuuccagcacgggaagguugagauuaucgcgaacgaucaaggaaauagaaccacacccuccuauguggcuuuuaccgacacagaacggcucauuggcgaugccgccaagaaccagguggcuaugaauccucagaacaccgucuucgacgccaaacgccugaucgggagaaaguuuaaugauccggugguucaggcugacaugaaacuuuggcccuuccaagugaucaacgagggaggcaagccuaagguccuggugucuuacaaaggcgaaaauaaggccuuuuaucccgaggaaauuagcuccaugguucucacaaaacugaaggagaccgcggaggccuuccuugggcauccugugacgaacgcugucaucaccgugcccgccuacuuuaaugauucucagcggcaggcuacaaaagacgccggagugauugcgggccugaacguccuccgcaucauuaaugaaccuaccgccgcugccaucgcuuaugggcuggauaagggaggccagggggagagacacguucugauuuucgaccucggaggcggcacauuugaugugagcauccugaccaucgacgaugggauuuucgaagugaaggccacggccggagacacacaucuuggcggggaggacuuugauaaccggcuggucucccacuucguggaggaauuuaaacgcaagcauaaaaaggacaucucucaaaauaaaagagcuguucggcgccucagaaccgcgugugagcgggccaagcgcacacugagcuccagcacccaggcuaaccuugaaauugauucucuguacgagggaaucgacuucuauaccuccauuacaagagcccgguucgaggaacucugcgccgaucuguuucgcggcacgcuggagccgguggaaaaagcucucagagacgccaagauggauaaggcgaaaauccacgacaucguccugguugggggaagcacccggauucccaaggugcagagacuucugcaggauuacuucaauggccgcgaccucaacaaaucuaucaacccugaugaggcuguggccuacggcgccgcuguccaagccgcuauucugaugggggacaaguccgaaaaagugcaggaccuucugcuccuggaugucgcgccccugagccucggacuggagacagccggcggggugaugaccgcccuuaucaagcggaauagcacaauuccuaccaagcagacgcaaaucuuuacaaccuauuccgacaaccagcccggaguucugauccagguguacgaaggcgagagagcuaugaccaaagauaauaaccuccuggggcgcuucgaccuuacaggcauuccgccugcuccccggggagucccucagaucgaggugaccuuugauauugacgccaauggcauccugaacguuacagccacggauaagagcaccgggaaagugaauaagauuacaaucaccaacgacaaaggaagacucuccaaggaagagauugaacgcaugguccuggaugcggagaaguauaaagccgaagacgaggugcaacgggagaagaucgcugccaaaaaugcucuggaaucuuacgccuucaacaugaagucugugguuuccgaugagggccucaaagggaagaucagcgaaucugacaagaauaaaauucuggauaaguguaacgagcuucuguccuggcucgaggucaaucagcuggccgaaaaagacgaguuugaccacaagagaaaagaacuggagcagaugugcaaccccaucauuacaaaacuuuaucagggaggcuguaccgggcccgcuugcggcacgggauacgugccuggccgcccggcgaccgggcccacaaucgaagagguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6736 - RNA, 2196 nt, Artificial Sequence
  mRNA product Design5 comprising derived and/or modified sequence from Homo sapiens__NP_068814.2 __HsHSPA2 (opt5)
gggagagucccgcagucggcguccagcggcucugcuuguucgugugugugucguugcaggccuuauucaagcuuaccaugagcgccagaggccccgcuaucgggauugaccugggaaccacauacuccugcgugggcgucuuccagcacgggaagguugagaucauugccaacgaucaaggaaaucggacgaccccuucuuauguggcguuuacagacaccgaacgccucaucggcgaugcugccaaaaaccagguggccaugaauccgacaaacaccauuuucgacgcuaagagacugaucgggcggaaauuugaggaugccacaguccagagcgacaugaagcauuggcccuuccgcgugguuuccgaaggaggcaaaccuaaggugcaggucgaguacaagggcgaaaccaaaacguuuuuccccgaggagaucucuagcauggugcuuaccaagaugaaagaaauugcugaggccuaucugggaggaaagguucacuccgcggugaucacagucccugccuacuuuaaugauucucaaagacaggcuaccaaagacgccggcacaauuaccgggcucaacgugcugcggaucauuaaugaacccacggcugccgcgaucgccuauggacuugauaagaagggcugugcugggggagagaaaaacgugcugauuuucgaccucggcggcgggacauuugaugucagcauccugaccaucgaggacggaauuuucgaaguuaaguccacagccggcgauacccaucuugggggagaggacuuugacaaucgcauggugagccaccucgcugaagaguucaaaagaaagcauaaaaaggauaucggcccuaacaaacgggccgugcgcagacugcggaccgccugcgaacgcgcuaagagaacacuuucuuccagcacgcaggcgucuauugagaucgacucccuguacgagggggucgauuuuuauaccagcauuacacgggcccgcuucgaggaacucaaugcugaccuguucagaggaacccuugaaccgguggagaaggcccugcgggaugccaaacucgacaagggccagauccaagaaaucguucuggugggcgggucuacacgcauucccaaaauccagaagcugcuccaggacuuuuucaacggaaaagagcugaauaaguccauuaacccugaugaggcugucgccuacggcgcggcugugcaggccgccauccuuauuggggauaagagcgaaaauguucaagaccugcuccugcuugaugugacgccccugucccucggaaucgagaccgcuggcggggucaugacaccucugaucaaaagaaacaccaccauucccacaaagcagacccagacauuuacgaccuacucugacaaccaaagcuccgugcugguccagguguaugaaggcgagcgggccaugacaaaagacaauaaccuccugggaaaguucgaucuuaccggcaucccgccugcucccagagggguuccucagauugaagugacauuugacaucgaugccaaugggauucugaacgucaccgcggccgacaaaagcacgggcaaggagaauaagaucaccauuacaaacgauaaagggcgccucucuaaggacgauaucgaccggauggugcaggaggcugaaagauacaaauccgaggaugaagccaaucgcgaccggguugcugccaagaacgcgcuggagagcuauaccuacaauaucaaacaaacaguggaggaugaaaagcugagaggaaagauuucugagcaggacaaaaacaagauccuggauaaaugucaggaagucauuaauuggcucgaccgcaaccagauggccgagaaggacgaauaugagcacaaacaaaaggagcuggaacgggugugcaaucccaucauuagcaaacuguaccagggcgggcccggcggaggcuccgggggaggcgggucuggagcuagcggcgggccuaccaucgaggaaguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6737 - RNA, 2799 nt, Artificial Sequence
  mRNA product Design5 comprising derived and/or modified sequence from Homo sapiens__NP_002145.3 __HsHSPA4 (opt5)
gggagagucccgcagucggcguccagcggcucugcuuguucgugugugugucguugcaggccuuauucaagcuuaccaugagcguggucggcaucgaccugggguuccaguccugcuacguugccguggcuagagccggaggcauugagaccaucgcgaacgaauauucugaucgguguacacccgcuugcauuagcuuugggccuaagaaucgcuccaucggagccgccgcuaaaucucaagugauuagcaacgccaagaauacgguccagggcuucaaaagauuucacgggcgggcuuucuccgacccguuuguggaggccgaaaagucuaaccucgcguacgauaucguucagcugcccaccggacuuacaggcaucaaagugaccuauauggaggaagaacgcaauuucacaaccgagcaggucacagccaugcugcucagcaagcugaaggaaaccgcugaguccgugcuuaaaaagccuguuguggacugugucgugagcgugcccugcuuuuacacggaugccgaaagacggucugucauggacgcuacccaaauugccggccugaacugucuccgccugaugaaugagacaaccgcgguugcccuggcuuaugggaucuacaaacaggaucucccugcccuggaggaaaagcccagaaacgugguguucgucgacaugggacauuccgcuuaucaggugagcguuugcgccuuuaaucggggcaaacuuaaggugcuggccacagcuuucgauaccacgcucgggggacgcaaguuugacgagguccuggugaaccacuucugugaagaguuuggcaaaaaguacaaacuugauauuaagucuaaaaucagagcgcugcuccggcugucccaggaaugcgagaagcugaaaaagcucaugagcgccaaugcuucugaccugccucuuuccauugaguguuucaugaacgauguugacgugagcgggacaaugaaucgcggaaaguuccuggaaaugugcaacgaccuccuggccagagucgagccgccccuucgguccgugcuggaacaaaccaaacucaagaaagaggauaucuacgccgucgaaauugugggcggcgcuacacgcaucccugccguuaaggagaaaaucucuaaguuuuucgggaaggagcugagcaccacccugaaugcggacgaagcugugacaagaggaugugcccuccagugcgccauucugucccccgcuuuuaaaguccgggaguucagcaucacggaugugguuccuuaucccauuucucuuagauggaacuccccggccgaagagggcagcucugacugcgaaguguuuagcaagaaccaugcugccccuuucuccaaaguccugaccuuuuaccgcaaggagcccuucacacucgaggcguauuacucuagcccucaggaucugcccuaucccgacccugccaucgcucaguuuuccgugcaaaaagugaccccgcagagcgaugggucuuccagcaagguuaaggucaaagugcgggugaauguccacggaauuuucucuguguccagcgccucccuuguugaagugcauaagucugaggaaaacgaggagcccauggaaacagaccagaaugcuaaagaggaagagaagaugcaagucgaucaggaggagccucacguggaggaacagcagcaacagacccccgccgagaacaaagcggaaagcgaggaaauggagacgucccaggccggcucuaaggacaagaaaauggaucagccuccccaagcuaagaaagccaagguuaaaacaagcaccguggaccugccgaucgagaaucagcuccuguggcagaucgacagagaaaugcugaaccucuacauugagaaugaagggaagaugaucaugcaggauaaacuggagaaggaacgcaacgacgcuaagaaugccgucgaggaguauguguacgaaaugcgggauaaacuuuccggagaguacgaaaaguuuguuagcgaggacgauagaaacucuuucacccugaaacucgaggacacagaaaauuggcuguaugaggauggcgaagaccaaccuaaacagguguacgucgauaagcuggccgagcuuaagaaccucggccagcccauuaagauccgcuuucaggaauccgaggagcggccuaaacuguucgaggaacuggggaagcaaauucagcaguauaugaaaaucaucagcucuuucaagaauaaagaagaccaauacgaucaccucgacgcugcggauaugaccaagguggagaaguccacaaacgaagccauggaguggaugaauaacaaacugaaccuucagaauaagcagagccugacgauggaccccguggucaaaucuaaggagauugaagcuaaaaucaaggagcucaccagcacauguuccccuauuaucagcaagcccaaaccgaagguugaaccucccaaagaggaacagaagaacgccgagcaaaauggacccguggacggccagggggauaacccuggaccgcaggccgcugagcagggcaccgacacagccgugcccucugauuccgacaaaaagcugccugaaauggauauugacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6738 - RNA, 2796 nt, Artificial Sequence
  mRNA product Design5 comprising derived and/or modified sequence from Homo sapiens__NP_055093.2 __HsHSPA4L (opt5)
gggagagucccgcagucggcguccagcggcucugcuuguucgugugugugucguugcaggccuuauucaagcuuaccaugagcguggucggcaucgaccugggguuccucaacugcuacauugccguugcuagauccggaggcaucgagaccauugccaaugaauauucugaucgguguacacccgcgugcaucagccuggggucccgcacgagagcuauuggaaacgccgccaagucucagaucgugaccaaugugcggaacacaauccacggcuuuaaaaagcugcaugggcgcagcuucgacgauccuauuguccaaaccgagagaauccggcuuccguacgaacuccagaaaaugcccaauggauccgcuggcgugaagguucgcuaucuggaggaagagagaccuuuugccauugaacaggugacaggcaugcuucuggcuaaacucaaggagaccucugagaacgcccugaagaaacccgucgcggacugugugaucagcauuccuuccuucuuuacagaugccgaacggcgcagcguuauggcugccgcucagguggccgggcugaauugccucagacugaugaacgagaccacggcggucgcccuugcuuacggaaucuauaagcaagaccugcccccucucgaugagaaaccgcggaaugugguguucauugacaugggccacucugccuaccagguccugguuugugcuuuuaacaaggggaaacuuaaggugcuggccaccacauucgaucccuaucucggaggccgcaauuuugacgaagcccugguggauuacuucugcgacgaguuuaagaccaaauacaagaucaacgucaaagaaaauuccagagcucugcuccggcuguaucaggagugugaaaaacuuaagaagcugaugagcgcgaacgccucugaucucccucugaauaucgagugcuucaugaacgaccuugacguguccagcaaaaugaaccgcgcucaguuugagcaacugugugccucucuccuggccagaguugaacccccucugaaggcugugauggagcaggccaaucuccagcgggaagauauuuccagcaucgagauugucgggggagcgacaagaauccccgcugugaaggaacagauuaccaaauucuuccugaaggacaucuccacgacacuuaacgccgaugaggccguugcucgcggcugcgcccugcaaugugcuauccucucuccggccuuuaaagugcgggaguucagcauuaccgaccuggucccuuacuccaucacacuuagauggaagaccagcuuugaagauggcucuggggagugcgaaguguucugcaaaaaucaucccgcgccuuuuuccaaggucauuaccuuccacaagaaagagcccuuugaacuggaggccuucuauacaaaccuccaugaggugcccuacccugacgcucgcaucggcagcuuuacgauucagaauguuuucccgcagucugauggagacagcuccaaggugaaagucaaggugcggguuaacauccacgggaucuuuucuguggccagcgcuuccgucauugaaaaacaaaaucuggagggagaucacagcgacgcccccauggaaaccgagacaucuuucaagaacgagaauaaggauaacauggacaaaaugcaaguggaccaggaagagggccaucagaagugucacgcggaacauaccccugaggaagagaucgaucacacaggggccaaaaccaaguccgcugugagcgacaaacaggauagacugaaucagacgcucaagaagggaaaaguuaagucuauugaccugcccauccaguccagccuuugccgccagcugggccaagaucuccugaacuccuauauugagaaugaaggcaaaaugaucaugcaggacaagcuggagaaagaacggaacgaugccaagaaugcugucgaggaauacguguaugacuuuagagaucgccuugggacaguguacgagaaauucauuaccccugaggaccucucuaagcugagcgccguccuggaagauaccgagaacuggcucuacgaagacggagaggaucagcccaaacagguguauguugacaagcugcaagaacuuaagaaauacggccagccgauccagaugaaguauauggagcacgaggaacggccuaaagcccugaacgaccucgggaagaagauccagcuggugaugaaagucauugaggcuuacagaaauaaggaugaacgcuaugaccaucuggaucccacagagauggagaaaguggaaaaguguaucuccgacgcgaugucuuggcuuaacagcaaaaugaaugcccaaaacaagcucucccugacccaggauccuguugugaaggucagcgagauuguggcuaaaucuaaggaacuggacaauuucugcaaccccaucauuuacaaaccuaagcccaaagccgagguuccggaagauaagccuaaggccaauuccgagcacaacggacccauggacggccagagcgggacagagacgaaaucugauuccaccaaggacagcucucaacauacaaaaagcuccggcgaaauggagguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6739 - RNA, 2241 nt, Artificial Sequence
  mRNA product Design5 comprising derived and/or modified sequence from Homo sapiens__NP_005338.1__HsHSPA5 (opt5)
gggagagucccgcagucggcguccagcggcucugcuuguucgugugugugucguugcaggccuuauucaagcuuaccaugaagcugagccucguggccgcuaugcugcuucugcucuccgccgcgagagcugaggaagaggacaaaaaggaagaugucggcaccguuguggggaucgaccugggaacaacguacucuugcgugggcgucuucaaaaacgggcggguggagauuaucgccaaugaucagggaaaccgcauuacccccagcuauguugccuuuacaccugaaggcgagagacuuaucggggacgcugccaagaaucaacugaccuccaacccggagaauacaguguucgaugcuaaacggcucauuggacgcaccuggaacgaccccucuguccagcaggauaucaaguuucugccuuucaaggugguugaaaagaagacaaaacccuacauccagguggacauuggcggcgggcaaaccaagacguuugccccugaggaaaucagcgcgaugguccugaccaaaaugaaggagacagccgaggcuuaucucggaaagaaagugacccacgccguggucacaguucccgcuuacuucaaugaugcccagagacaggcgaccaaggacgccggcacgauugcugggcugaacgugaugcggaucauuaaugaaccuacagccgcugccaucgccuauggacuugauaaacgcgagggcgaaaagaacauucugguguuugaccucgggggaggcaccuucgaugucucccugcuuacaaucgacaauggcguguuugagguuguggcuaccaacggggacacccaucugggaggcgaagauuucgaccagagagucauggagcacuuuaucaaacucuacaagaaaaagacagggaaggaugugcggaaagacaaucgcgcgguucaaaagcugagacgggagguggaaaaagccaagcgcgcucugucuagccagcaucaggccagaauugagaucgaauccuucuaugagggagaagauuuuagcgagacgcucacccgggccaaauucgaggaacugaacauggaccuuuuccgcucuacaaugaagccgguccagaaggugcuggaggauuccgaccucaaaaagagcgauauugacgaaaucguccuggugggcgggucuacccggauucccaaaauccaacagcuuguuaaggaguuuuucaauggaaaagaaccuuccagaggcaucaaccccgaugaggcuguggccuacggcgcggcuguccaggccggggugcugagcggagaccaagacacaggcgaucucguucugcuggacguguguccucucacccuggggauugagacggucggaggcgugaugacaaaacuuauccccagaaacaccgugguuccgaccaagaaaucucagaucuuuuccacagccagcgauaaucagccuaccgucacaauuaagguguacgaaggggagcgcccccugacgaaagacaaccaccuccugggcaccuucgaucuuacaggcauuccucccgcuccccggggagugccucagaucgaagucaccuuugagaucgacgugaaugggauucugagaguuacagccgaggauaagggaaccggcaacaaaaauaagaucacgauuaccaacgaccaaaaucgccucacaccggaagagaucgaacggauggugaacgaugcugagaaguucgccgaagaggacaaaaagcugaaagagagaauugauacccgcaaugaacuggaguccuaugcguacucucucaagaaccagaucggggacaaagaaaagcugggaggcaaacuuagcuccgaggauaaggaaacaauggagaaggccgucgaggagaaaauugaauggcuggaaagccaucaggacgcugacaucgaggauuuuaaggccaaaaagaaagaacucgaggagaucgugcagcccauuaucucuaagcuguauggguccgcuggcccucccccuaccggagaagaggacacggccgaaaaggaugagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6740 - RNA, 2208 nt, Artificial Sequence
  mRNA product Design5 comprising derived and/or modified sequence from Homo sapiens__NP_002146.2__HsHSPA6 (opt5)
gggagagucccgcagucggcguccagcggcucugcuuguucgugugugugucguugcaggccuuauucaagcuuaccaugcaggcccccagagagcuggcugugggcaucgaccucgggaccacauacagcugcgucggaguuuuccaacagggccggguggaaauucuggccaacgaucaggggaaucgcacgaccccuuccuauguggcguuuacagacaccgagagacuugucggagaugcugccaagucucaggccgcucugaacccgcacaauacaguguucgacgccaaacggcucaucggccgcaaguuugcugauaccacaguucaaagcgacaugaaacauuggcccuucagaguggucuccgaagggggaaagccuaaagugcggguuuguuaccgcggcgaggauaagaccuuuuaucccgaagagauuucuagcauggugcuguccaagaugaaagagacggccgaagcguaccuuggccagccugucaagcacgccgugaucaccgugcccgcuuauuucaacgacucucagagacaggccacaaaagaugcuggggccauugcgggacugaauguccuccggaucaucaacgagccuaccgccgcugccauugcuuacggccuggaccgcagaggggccggagaacggaauguucugaucuuugaucucggcgggggaacauucgacgugagcgugcuguccauugaugccggcgucuuugaggugaaggcuaccgcgggcgacacgcaucuugggggagaggacuucgauaaccgccugguuaaucacuuuauggaagaguucagacggaaacauggcaaggaccucagcgggaacaagcgcgcccugagacggcuuagaacagcuugcgaacgcgccaaacggacccugucuuccagcacacaagccacccucgagaucgauucucuguuugaaggaguggacuucuauaccuccauuacaagagcucgcuucgaggagcuguguagcgaucucuuucggucuacgcuggaaccggucgagaaggcccuuagagacgcgaaacuggauaaggcucagauccacgacgugguucucgugggcggguccacccgcauucccaaaguccagaagcugcuucaggauuucuuuaauggaaaagaacugaacaagagcaucaauccugacgaggccguggccuacggcgcugccguccaagcugccgugcucaugggcgauaagugcgaaaaaguucaggaccugcugcuccuggacguggcgccccuuucccuggggcucgagacagccggaggcgucaugaccacacugauccagcggaacgcuaccauuccuacgaagcaaacacagaccuucaccacauacucugauaaucagcccgggguguuuauccagguuuaugagggagaaagagccaugaccaaagacaacaaccuucugggccgcuucgagcucagcgggauuccgccugcuccccggggcgugccucaaaucgaagucacauuugauauugacgccaauggaauccuguccgugacggcgaccgauagaagcacaggcaaggccaacaaaaucaccauuacaaaugacaaggggcgccugucuaaggaggaaguggagcggaugguucacgaggcugaacaguacaaagccgaggaugaagcucagagagaccgggucgccgccaagaacucccucgaggcucauguguuccacgugaaaggaagccugcaggaggaaucucuucgcgauaagauccccgaggaagacagacggaaaaugcaagauaaguguagagagguccuggcguggcucgaacauaaucagcuggccgagaaggaggaauaugagcaccagaaacgcgaacuggagcagauuugccggcccaucuuuagcagacuuuacggcgggccuggagugccgggcggguccucuuguggcacccaagcucgccagggagaccccagcacgggcccuauuaucgaagagguugauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6741 - RNA, 1380 nt, Artificial Sequence
  mRNA product Design5 comprising derived and/or modified sequence from Homo sapiens__P48741__HsHSPA7 (opt5)
gggagagucccgcagucggcguccagcggcucugcuuguucgugugugugucguugcaggccuuauucaagcuuaccaugcaggcccccagagagcuggcugugggcaucgaccucgggaccacauacagcugcgucggaguuuuccaacagggccggguggaaauucuggccaacgaucaggggaaucgcacgaccccuuccuauguggcguuuacagacaccgagagacuugucggagaugcugccaagucucaggccgcucugaacccgcacaauacaguguucgacgccaaacggcucaucggccgcaaguuugcugauaccacaguucaaagcgacaugaaacauuggcccuuccagguggucuccgaagggggaaagccuaaagugagaguuuguuaccggggcgaggauaagaccuuuuaucccgaagagauuucuagcauggugcuguccaagaugaaagagacggccgaagcguaccuuggccagccugucaagcacgccgugaucaccgugcccacauauuucucuaacagccagcgccaagcuaccaaagacgccggggcuauugccggacugaagguccucccuaucaucaaugaggcgacagccgcugccauugcuuacggccuggauagacgcggggccggaaaacggaacguucugaucuuugaccucggcgggggaaccuucgauguguccgugcugagcauugacgccggcgucuuugaagugaaggcuacggcgggcgauacacaucuugggggagaggacuucgacaauagacugguuaaccacuuuauggaggaguuccggcgcaagcauggcaaagaucucucugggaauaagagagcccugcggcgccuuagaaccgcuugcgagcgggccaaaagaacaccguccagcucuacccaggccacccuggaaaucgacucccucuuugagggaguggauuucuauaagagcauuacacgcgcucgguucgaagaacuguguucugaccuguuuagauccacgcucgagcccgucgaaaaagcccugcgcgaugcgaaacuugacaaggcucagauccacgauuucgugcugggcgggggacuccacagccauccucagggcgccgagguugccgcuggccugcuucaacggcagggggccgaacaggagcaccaacccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6742 - RNA, 2217 nt, Artificial Sequence
  mRNA product Design5 comprising derived and/or modified sequence from Homo sapiens__NP_006588.1 __HsHSPA8 (opt5)
gggagagucccgcagucggcguccagcggcucugcuuguucgugugugugucguugcaggccuuauucaagcuuaccaugagcaagggccccgccguggggaucgaccugggaaccacauacuccugcgucggcguuuuccagcacgggaaaguggagauuaucgcuaacgaucaaggaaauagaacgaccccuucuuauguggccuuuacagacaccgaacggcucauuggcgaugcggcuaagaaccaggucgccaugaauccgacaaacaccguguucgacgccaaacgccugaucgggagacgguuugaugacgcuguugugcagagcgauaugaagcauuggcccuucauggucgugaaugacgccggacgcccuaaaguucagguggaguacaagggcgaaacaaaguccuuuuaucccgaggaagucucuagcauggugcuuaccaaaaugaaggagauugcugaggccuaccugggcaaaacggugaccaacgcggucguuacagugccugccuauuucaaugauucccaaagacaggcuaccaaggacgccgggacaaucgcuggacucaacgugcugcggaucauuaaugaacccaccgccgcggccaucgcuuacggccuugauaaaaaggucggggccgagcgcaacgugcugauuuuugaccucggaggcgggacguucgauguuucuauccugacaauugaagacggaaucuuugaggugaagucuaccgcuggcgacacacaccugggcggggaggauuucgacaauagaauggucaaccauuuuauugccgaauuuaaacggaagcacaaaaaggauaucuccgagaauaaacgcgccgugagacggcuccgcaccgcuugugaaagagcgaagcggacccugagcagcuccacacaggccagcaucgagauugacucucuuuaugaaggaaucgauuuuuacacguccauuacccgcgcuagauucgaggagcugaacgccgaccucuuccggggcacacuggauccuguugaaaaagcccuuagagacgcuaagcuggauaagagccagauccaugacauugugcucgucgggggaucuacccgcaucccgaaaauccaaaagcugcugcaggauuucuucaauggcaaagagcucaacaaguccauuaaccccgacgaagccguggcguacggggcugccguccaggccgcuauccugagcggagacaaauccgagaaugugcaggaucuucugcuccuggacguuacaccucuuucucugggcauugaaaccgccggcggggugaugacgguccucaucaagcggaacacaaccauucccaccaagcaaacacagaccuuuacaacguauagcgauaaucagccuggagugcugauccaaguuuacgagggcgagagagcuaugaccaaagacaacaaucugcucgggaaguucgaacugacaggaaucccgcccgccccucgcggcgugccccagauugaggucaccuuugauaucgacgcgaacgggauucuuaauguguccgccguggauaaaagcacaggcaaggaaaacaaaaucaccauuacgaaugacaagggacggcugucuaaggaggauaucgaaagaaugguucaggaggcugagaaauauaaggccgaagacgagaaacagcgcgauaaggucuccagcaaaaacucucucgaaagcuacgcuuucaauaugaaggccaccguggaggacgagaagcugcaaggcaaaauuaacgaugaagacaagcagaaaauccuugacaagugcaaugagaucauuaacuggcuggauaaaaaucagacagcggaaaaggaggaauuugagcaccagcaaaaagagcucgaaaagguguguaacccuaucauuaccaagcuguaucaguccgccgggggaaugcccggcgggaugcccggaggcuucccugggggcggagcuccgcccucuggcggggccagcuccggaccuacaaucgaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6743 - RNA, 2316 nt, Artificial Sequence
  mRNA product Design5 comprising derived and/or modified sequence from Homo sapiens__NP_004125.3 __HsHSPA9 (opt5)
gggagagucccgcagucggcguccagcggcucugcuuguucgugugugugucguugcaggccuuauucaagcuuaccaugaucagcgccuccagagcugccgcggcucggcuggugggcgccgccgcuucucgcgggcccaccgccgcuagacaccaggacagcuggaacggacucucccaugaggccuuccggcuggucucucgcagagauuacgcgagcgaagccauuaagggcgcuguuguggggaucgaccuuggaacaacgaauagcugcguggccgucauggagggcaaacaagcuaaggugcuggaaaacgccgagggggcgcggaccacaccuucuguuguggccuuuaccgcugauggagaacgccucgucggcaugccggccaaaagacaggcugugacaaaucccaacaauaccuucuaugccacaaagcggcugauuggccgcagauacgacgauccugagguucagaaagacaucaagaacgugcccuuuaagauuguccgggccagcaauggggaugcuuggguggaggcgcacggaaaacuuuauuccccuagccagaucggcgccuucgugcugaugaagaugaaagaaaccgcugagaacuaccucgggcauacggccaagaaugccgucaucaccguucccgcuuauuuuaacgacucucaacgccaggccacaaaagaugcgggacagauuuccggccugaaugugcugagagugaucaacgaaccuaccgcugccgcccucgcuuacgggcuggacaagagcgaggauaaggucauugccguguaugaccuuggaggcggcacauucgauaucucuauucuggagauccagaaagggguuuuugaagugaaguccaccaauggagacacguuccucggcggggaggacuuugaucaagcucugcuucggcacauugucaaagaguucaagcgcgaaacaggaguggaccugaccaaagauaacauggcccuccagagaguucgggaagcggccgagaaggcuaaaugugagcuguccucuuccgugcagacagacaucaaucugccguaccucaccauggauagcuccggccccaagcaucugaacaugaaacuuaccagagcccaguuugaagggaucgucacagaccugauucgccggacgaucgcuccuugccaaaaggccaugcaggaugcggaggugucuaagagcgacauuggagaagucauccucgugggcggcaugaccagaaugcccaaaguucagcaaacagugcaggaucuguucgggcgcgccccuuccaaggcugucaaccccgacgaggccguggcuauuggagccgccauccagggcgggguucuugcuggagaugugaccgacguccugcuccuggacgugacaccgcugagccucggcaucgaaacccugggcggcguguuuacgaaacuuauuaaucggaacacaaccaucccuaccaagaagucucagguuuucuccacagcggccgauggacaaacccaggucgagauuaaagugugucagggcgagagagaaauggcuggggacaauaagcugcucggacaguucacacugaucggcauucccccugcuccccgcggggugccccaaaucgaggucacguuugauaucgacgccaacggaauugugcacguuagcgccaaagauaagggcaccgggcgggaacagcagaucgugauucagucuagcggcggacuuuccaaagacgauaucgagaauauggucaagaacgccgaaaaguacgcggaggaggacagacgcaaaaaggaacggguggaggcuguuaauauggccgaaggcauuauccacgauacagagaccaaaauggaggaguucaaggaccaacugccugccgaugaaugcaacaaacucaaggaagagauuucuaagaugagagaacugcuggcucgcaaagacagcgagacaggggagaauauccggcaggccgcguccagccuccagcaggcuucucugaaacuuuuugaaauggccuauaagaagauggccuccgagagagaaggaagcgggucuuccgggaccggagagcaaaaagaagaucagaaggaggagaaacagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6744 - RNA, 2304 nt, Artificial Sequence
  mRNA product Design5 comprising derived and/or modified sequence from Homo sapiens__NP_079291.2__HsHSPA12A (opt5)
gggagagucccgcagucggcguccagcggcucugcuuguucgugugugugucguugcaggccuuauucaagcuuaccauggccgacaaggaggcuggcgggagcgauggacccagagaaaccgccccuacauccgcguacucuagcccggcucggucccugggcgacacggggaucacaccccucucuccuagccacauugugaacgauaccgacuccaaugucucugagcagcagagcuuccugguugugguggccgucgauuuuggaaccacauccagcggcuaugccuacucuuucaccaaagaacccgagugcauccaugugaugcgcagaugggaagggggagacccuggcguuuccaaccaaaagacacccaccacgauucuucugaccccugagcggaaauuucacagcuucggcuaugcugcccgcgauuuuuaccaugaccucgauccgaaugaggcuaagcaguggcuguaucuugaaaaauucaagaugaagcugcacacaaccggggaccucacaauggauaccgaccugacggccgcgaacggcaaaaaggugaaagcccuggagaucuuugcuuacgcccuccaguauuucaaggaacaagcucugaaagagcuuucugaucaggccggauccgaguuugaaaauagcgacgucagaugggugauuacaguucccgcgaucuggaagcagccugccaagcaguucaugcggcaagcugccuaccaggcugggcuggccucucccgagaacuccgaacagcucaucauugcccuggagccugaagcugcgagcaucuacugucgcaaacuuagacugcaucagaugauugagcucuccucuaaggccgcugugaauggauauagcggcuccgacaccgucggggccggauuuacacaagccaaagagcacauccggcgcaacagacagagccggaccuuccugguggaaaaugugauuggcgagaucuggucugaacuggaggaaggcgauaaguacgucguuguggacuccgggggaggcaccguggaucucacaguccaccagauucgccugcccgaggggcaucuuaaagagcuguauaaggcuacgggaggcccguacgggagccucggaguggacuaugaauuugagaaacugcuuuacaagaucuucggcgaagauuucaucgagcaauuuaagauuaaaagaccugccgcguggguugaccugaugaucgcuuucgaaucucggaagcgcgccgccgcucccgauagaaccaacccucucaauauuacacugcccuuuagcuucaucgacuauuacaaaaaguuucggggccacuccguggagcaugcccugagaaaaucuaacgucgauuucgugaaguggagcucccaggggaugcuccgcaugagccccgacgcuaugaaugcccuguuuaagccuaccauugauucuaucaucgagcaccuucgggaccuguuccagaaaccggaaguuuccacagugaaguuucucuuccuggucggaggcuuugcggaggcuccccuucugcagcaagccgugcaggccgcuuucggggaccagugcagaauuaucauuccucaggaugucggacucaccauccugaaaggcgccgugcuguuugggcucgaccccgcgguuauuaaggugcgccggagcccucugacguacggcgucggagugcuuaacagauauguugaaggcaaacaucccccggagaagcugcucgugaaggaugggacacgcugguguaccgacgucuucgauaaauucaucucugccgaccaauccguggcucugggagagcuggugaagcggagcuacaccccugccaaacccucccagcuuguuaucgucauuaauaucuauucuagcgaacacgauaacguguccuuuauuacagacccuggcgugaagaaaugcgggacccucagacuggaucugacaggaacgucuggcaccgcuguccccgcccgccgggagauccagacacucaugcaguucggggacaccgaaauuaaggccacagcuaucgauauugcgaccagcaaguccgugaaaguuggcaucgacuuucugaacuacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6745 - RNA, 2337 nt, Artificial Sequence
  mRNA product Design5 comprising derived and/or modified sequence from Homo sapiens__NP_443202.3 __HsHSPA12B (opt5)
gggagagucccgcagucggcguccagcggcucugcuuguucgugugugugucguugcaggccuuauucaagcuuaccaugcuggccgugcccgagaugggccuccaggggcuguacaucggaagcuccccugaaagaucuccgguccccagcccucccggcuccccucggacccaagagucuugcgggauugcuccccuuacaccuagccaguccccgaagcccgaaguucgcgccccucagcaggcgucuuucagcgugguggucgcuaucgacuuuggaacgaccuccagcggcuaugccuucucuuuugccuccgaucccgaggcuauucacaugaugagaaaaugggaagggggagacccuggcguggcccaucaaaagacacccaccugucugcuccugacaccggagggcgcuuuccacagcuuuggguacaccgcccgggauuauuaccaugaccuugauccugaggaagcgcgcgacuggcuguauuucgagaaauuuaagaugaaaauccacucugccacagaucucacccugaagacgcagcuggaagcuguuaacggaaagaccaugcccgcccucgagguguucgcucaugcccugagauuuuuccgggagcacgcgcuucaggaacugcgcgagcaguccccuagccuccccgaaaaagacacagucagaugggugcugaccguucccgccauuuggaagcaaccugcuaaacaguuuaugcgggaggccgcuuaccuugccggccuggugucucgcgaaaaugccgagcagcuccugaucgcucuggagccggaagcggccuccgucuauugcagaaagcuccggcugcaccagcuucuggaucucagcgggcgcgcucccggaggcgggagacugggagagcggcgcuccaucgacucuagcuucagacaagcccgggaacagcuuagacgcucccggcauagcagaacauuucugguggagucuggcgugggcgaacucugggccgagaugcaggcuggggaucgcuacgucguugccgacuguggaggcgggaccguggaucugacggugcaccaacuggagcagccucauggaacacucaaagaacuguacaaggcguccggcgggcccuauggagcugucggcguggaccuugccuucgagcagcugcucugccggauuuucggcgaagacuuuaucgccaccuucaagagacagcgcccugcugccuggguugaucugacaauugcuuuugaggcccggaaaagaaccgcggggccccaccgcgccggagcucuuaacaucagccugccguucucuuuuauugacuucuaccggaagcaaagaggccacaauguggaaaccgcccuccgccggagcuccgucaacuuugugaaauggucuagccaggggaugcugagaauguccugugaggcuaugaaugagcuguuccagccuacaguuagcggaaucauucagcauaucgaagcccuccuggcgcggcccgaggugcaaggcgucaaacuucuguuucucgucgggggcuucgccgaaucugcugugcugcagcacgccgugcaggcugcccugggagcccgcggccuuagaguuguggucccucaugauguggggcucacgauccugaagggagcuguucuguuuggccaggcgcccggggugguccgggugagacgcuccccucucaccuauggagugggcguucugaaccgguucguccccgggagacacccgccugagaaacuucuggugcgcgacggcagacgguggugcacagauguguuugagcgcuucgucgccgcugaacaaagcguggcccucggagaggaaguuagacggucuuacugucccgcccgccccggccagagacgggugcugauuaaucuguauugcugugcugccgaggacgcgcgcuucaucaccgauccuggggucagaaagugcggagcucuuucccucgaacuggagccggccgacuguggccaggauacagccggggcucccccuggacggcgcgagauuagagccgcgaugcaguuuggcgacaccgaaaucaaggugacggcuguugaugugagcacaaaccgguccgucagagccucuauugacuuccugagcaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6746 - RNA, 1692 nt, Artificial Sequence
  mRNA product Design5 comprising derived and/or modified sequence from Homo sapiens__NP_008879.3__HsHSPA13 (opt5)
gggagagucccgcagucggcguccagcggcucugcuuguucgugugugugucguugcaggccuuauucaagcuuaccauggccagagagaugaccauccugggcagcgcugugcucacacugcuucuggccggguaccucgcgcagcaauaucugccccuuccuacgccgaaggucauuggaaucgaccugggcaccacauacugcuccguugggguguucuuucccggaaccggcaaagugaaggucauuccugaugaaaacgggcacaucucuauucccagcaugguguccuucacagacaaugauguuuaugugggauacgagucugucgaacucgcugacagcaacccucagaauaccaucuaugaugccaaacgguuuaucggcaagauuuucacagccgaggaacuggaggcugagaucggccgcuaccccuuuaaagugcugaacaagaaugggaugguugaguucuccgugaccucuaacgaaacgauuaccgucagcccugaauaugugggauccagacuccugcuuaagcugaaagagauggccgaggcuuaccucggcaugccgguggccaaugcggucaucagcguucccgccgaauuugaccugaagcagcggaacucuacaauugaggcugccaaucuugcugggcugaaaauccuccgcgugauuaacgaaccuaccgccgcggccauggcuuacggacugcauaaggccgauguguuccacguccuggugaucgaccucggcgggggaacacuggauguuucccuucugaauaaacagggcggcauguuucucaccagagcuaugagcgggaacaauaagcugggaggccaagacuucaaccagcggcuucugcaguaucucuacaagcagaucuaucaaacguacggguuugugcccucucgcaaagaggaaauucauagacugcggcaggccgucgagauggugaagcugaaucucacacugcaccaguccgcccagcuuagcguucugcucaccguggaggaacaagaucgcaaagagccucauucuuccgacacagaacugcccaaggauaaacuuagcuccgcugacgaccacagagucaacucuggauucggccgggggcugagcgauaagaaauccggagagagccaggugcucuuugaaaccgagaucucucgcaagcuguucgacacccugaacgaggaucucuuccagaagauucuggucccgauccaacaggugcuuaaagaaggccaccuggagaagacagaaauugacgagguugugcucgucggcggguccacgagaaucccucggauccgccaggugauucaggaauuuuucggaaaagaucccaauaccagcguugacccugaucuggcgguggucacaggcguggccauccaagcugggauugacggaggcucuuggccccuucaggugagcgcccuggagauccccaacaagcaucuccagaaaaccaauuuuaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6747 - RNA, 1806 nt, Artificial Sequence
  mRNA product Design5 comprising derived and/or modified sequence from Homo sapiens__NP_057383.2__HsHSPA14 (opt5)
gggagagucccgcagucggcguccagcggcucugcuuguucgugugugugucguugcaggccuuauucaagcuuaccauggccgcuaucggcguccaccuggggugcaccagcgccugugucgcgguuuacaaggacggcagagcuggagugguggccaacgaugccggggaccgggucacacccgcugugguugccuauuccgagaaugaagagauugugggacucgcugccaaacagucucgcaucagaaacauuagcaauacggucaugaaggugaaacaaauccugggccgguccucuagcgauccucaggcgcagaaguacauugccgaauccaaaugccuuguuaucgagaagaacgggaagcugcgcuaugaaaucgacaccggagaggagacaaaauucgugaauccggaagaugucgcuagacucaucuuuucuaagaugaaagagaccgcccauagcgugcugggcuccgacgcuaacgauguggucauuacaguucccuucgacuuuggcgaaaagcagaaaaaugcccuuggggaggcggcccgggcugccggauucaacgugcugcgccucauucacgagccuagcgcugcccugcuggccuacggcaucgggcaagauucucccaccggaaaguccaauauucucguguuuaagcugggcgggacaagccuuucucuguccgucauggaagugaacagcggaaucuauagaguucucucuaccaauacggacgauaacauuggcggcgcucauuucaccgagacacuggcgcaguaccuugccuccgaauuucagcggagcuucaaacacgacgugcgcgggaaugcuagagccaugaugaagcugaccaacuccgccgaggucgcuaaacauucucucagcacacugggauccgccaauuguuuucuggauagccucuaugaaggccaggacuucgacugcaacgugucucgggcgcgcuuugagcugcuuuguuccccucuguucaacaagugcaucgaggcuaucagagggcuccuggaucaaaauggauuuaccgccgacgauauuaacaaaguugugcuuuguggcgggagcucucggauccccaagcugcagcagcucauuaaagaccuguucccugccgucgaacugcucaauagcaucccgcccgaugaggugauuccuaucggagcugccaucgaagcuggcauucugaucggcaaggagaaccuucuggucgaagacucccucaugauugagugcucugcccgcgauauccuggugaaggggguugacgagagcggagcguccagauucacggugcuuuuucccagcggcacaccucugcccgcccggagacagcacacccuccaagcuccggggucuauuuccagcgucugucuggaacuguacgagucugauggcaaaaauuccgccaaggaagagacaaaauucgcucaggugguucuccaggaccuggauaagaaagaaaacggacuucgcgacauccuggccgugcucaccaugaagcgggacgggagccugcacgugaccugcacagaucaagagacgggcaagugugaggcgaucuccauugaaaucgccucuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6748 - RNA, 2853 nt, Artificial Sequence
  mRNA product Design5 comprising derived and/or modified sequence from Homo sapiens__NP_006635.2 __HsHSPH1 (opt5)
gggagagucccgcagucggcguccagcggcucugcuuguucgugugugugucguugcaggccuuauucaagcuuaccaugagcguggucggccuggacguugggucccagucuugcuacaucgccguggcuagagccggaggcauugagaccaucgcgaacgaauuuagcgaucgguguacacccuccgugauuucuuuugggagcaagaaucgcacgaucggagucgcugccaaaaaccaacagauuacccacgccaauaacacaguguccaauuucaagagauuucauggccgggcuuucaacgacccuuuuauccagaaagagaaggaaaaucucucuuaugaucugguuccgcuuaaaaacgggggagugggcaucaaggucauguacaugggcgaggaacaccuguucagcguggagcagauuaccgccaugcuccugacaaaacuuaaagagaccgcugaaaauucccugaagaaacccguuacagacugcgugaucagcgucccuucuuucuucaccgaugccgagcgcagauccgugcucgacgcggcccaaauuguggggcugaacugucugcggcucaugaaugauaugacggcugucgcccugaacuauggaaucuacaagcaggaccuucccagccuggaugaaaaaccucgcauuguuguguuuguggacaugggccauucugcuuuccaggucuccgccugcgcguuuaauaaggggaagcucaaagugcugggaaccgccuucgaucccuuucuuggcgggaagaacuucgacgagaaacugguugagcacuucugugcugaauuuaagacaaaauauaagcucgaugccaaaagcaagaucagagcucugcugcggcucuaccaggagugcgaaaagcugaaaaagcugaugucuuccaauagcaccgaccuuccucucaacauugaguguuucaugaacgacaaagauguguccggaaagaugaaucgcucucaauuugaggaacugugcgccgagcuucugcagaaaaucgaagucccgcucuauagccugcuggagcagacacaucucaagguggaagacguuuccgccguggagaucgucggcggcgcuacccggauucccgcggugaaggaaagaaucgccaaauucuuugggaaggauauuagcacgacacugaacgcugacgaggccgucgcccgcggaugugcccuucagugcgcuauccugucuccugcguucaaagugagagaguuuuccguuaccgaugcugugcccuucccuauuagccucaucuggaaucacgacucugaagauacagagggcguccacgaaguguuuagccggaaccaugccgcccccuucuccaagguucugaccuuucuucgcagagggccguucgagcuggaggcuuuuuacucugacccucaaggagugcccuacccugaagccaaaaucggccgguucgucgugcagaaugugagcgcucagaaggauggggagaaguccagaguuaaagucaaggugcgcgugaacacccacggaauuuucacaaucagcacggccucuauggucgaaaaagugcccaccgaggaaaaugagauguccagcgaggcggacauggaaugucucaaccaacggcccccugagaauccggauacagacaagaacguucagcaggacaauucugaagccggcacccagccccaagugcagacagaugcucagcagaccucccaaagcccucccuccccugagcugacgucugaagagaacaaaauucccgacgccgauaaggcuaaugagaagaaagucgaccagccgccugaagccaagaaacccaagaucaaagugguuaacguggagcugccuauugaagcgaaucucgucuggcagcugggcaaggaucuucugaacauguauaucgagacagaagggaaaaugaucaugcaggacaagcucgagaaggagagaaacgaugccaaaaaugcuguggaagaguacguuuaugaauuucgcgacaagcugugcggacccuacgagaaauucauuugcgaacaagaucaucagaacuuucugcggcuucucaccgagaccgaggacuggcuguaugaagagggcgaagaucaggccaagcaggcuuacguggacaaacuggaggagcucaugaagaucgggacaccugucaaggugagauuccaagaagccgaggaacgccccaaaauguuugaggaacugggacagcggcuucagcacuaugccaagauugcugcggauuucagaaauaaagacgagaaguacaaccacaucgacgagagcgaaaugaaaaagguggagaaguccgucaaugaaguuauggaguggaugaacaaugugaugaacgcccaagcuaaaaagucucuggaucaggacccggugguccgcgcccaggaaauuaaaaccaagaucaaagagcucaauaacacaugugagccugugguuacgcagcccaagcccaagauugaaagcccuaaacuggagcggaccccgaauggccccaacaucgauaagaaagaagaggaccuggaagauaagaauaacuuuggggccgagccuccccaucaaaauggcgagugcuacccuaacgaaaagaacuccgugaauauggaccuugauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6749 - RNA, 3276 nt, Artificial Sequence
  mRNA product Design5 comprising derived and/or modified sequence from Homo sapiens__NP_006380.1 __HsHYOU1 (opt5)
gggagagucccgcagucggcguccagcggcucugcuuguucgugugugugucguugcaggccuuauucaagcuuaccauggccgacaaggugagacggcagcgccccagacggcgcgucugcugggcucugguugccgugcuccuggcggaucuucuggcucucagcgacacccuggccgugauguccgucgaucuuggcucugagagcaugaaaguggccaucguuaagccuggggugccgauggaaaucguccugaacaaagaguccagacggaagacacccgugaucguuacgcucaaagaaaaugagcgcuucuuuggagacucugcugccagcauggcuauuaagaacccuaaggccacccugagauacuuccaacaucugcucggcaaacaggcggauaauccccacguggcccuguaucaggcucgguuuccugaacacgagcuuacauucgacccccagcgccaaaccguccauuuucagaucuccucucagcugcaguucagcccugaggaagugcucgggauggugcugaacuacuccagaagccuugccgaggauuuugcugaacaaccgauuaaggacgccgucaucacaguucccguguucuuuaaucaggcggagcggcgcgccgugcugcaggcugccagaauggcuggacucaaaguccugcagcugaucaacgauaauaccgccacagcccucucuuauggcguguuccggcgcaaggacauuaacaccacggcucaaaauaucauguuuuacgauaugggguccggaagcaccguuuguacaauugugaccuaucagauggucaaaacaaaggaggcgggcaugcagccucaacugcagaucagaggcgugggguucgaccggacccuuggaggccuggaaauggagcucagacugcgcgaacggcuugccgggcuguuuaacgagcagagaaagggacagcgcgcuaaagauguucgggaaaaucccagagccauggccaagcuccugcgcgaggcuaaccggcugaaaacggugcucucugccaaugcggaccacauggcucaaauugagggccugauggacgaugucgacuucaaggccaaagugacaagagucgaguucgaggaacuuugcgccgaucuguuugagcgcgugccugggcccguucagcaggcucuccaguccgccgaaaugagccuggacgagaucgagcaagugauucuugucggaggcgcuacccgggugccgagaguucaggaagugcugcucaaggccgucggcaaagaggaacuggggaagaacaucaaugcggaugaggccgcugccaugggagcuguguaccaggccgcggcccugucuaaggcuuucaaagugaagccuuuuguuguccgcgacgccgugguguaucccauccucgucgaguucacacgggagguggaggaagaaccuggcauucauucccugaaacacaacaagagaguucuuuuuagccggauggggcccuacccccagcgcaaagugaucaccuucaacagauacucccacgauuuuaauuuccauauuaacuauggagaccugggcuuucucgggccugaagaucugcgggucuucggaucucaaaaucugaccacagugaagcucaagggcguuggcgacagcuuuaaaaaguacccggauuaugaguccaaagggaucaaggcucacuucaaccucgacgagagcggagugcugucucuggacagagucgaauccguguuugagacgcucguugaagauagcgccgaggaagagucuacccugacaaaacuuggcaauaccauuagcucccuguucgggggaggcacaacccccgacgccaaggagaacgggacggauacagugcaggaagaggaagagucuccugcugaaggcagcaaggacgagcccggagagcaggucgaacucaaagaggaagcggaggccccuguggaagauggcucccagcccccgccucccgagccuaagggggacgcuacccccgagggagaaaaagccaccgagaaggaaaauggcgauaaaagcgaggcccaaaagccuucugagaaggcugaagccgggcccgagggaguggcgccggcuccugaaggcgagaaaaagcagaaacccgcccgcaagcggagaauggucgaagagaucgggguugagcugguggugcuggaccuucccgaucucccugaagacaaacuggcccaguccguccaaaagcugcaggaucucacacugcgcgaccuugagaaacaggaaagagagaaggcugccaacagccuggaagcguucaucuuugagacccaggauaagcucuaccaaccggaguaucaggaagugucuacagaggaacagcgggaggaaauuuccggcaaacugagcgcugccuccacguggcuggaggacgagggaguuggcgccaccacagugaugcuuaaggaaaaacucgcugagcugcgcaagcugugucaggggcuuuucuuuagagucgaagaacggaaaaaguggcccgagcgccugucugcccuugacaaucugcucaaccauagcuccauguuccugaagggagcuagacugaucccugaaauggaucaaauuuuuaccgagguggaaaugacaacccuugagaaaguuaucaaugaaacgugggccuggaagaacgcgacccucgccgagcaggcuaaacugcccgccacagagaagccugugcugcucucuaaagacauugaagcuaagaugauggcccuggaucgggagguccaguaccuucugaauaaggccaaauucaccaagccccgcccuagacccaaagacaagaacggcacacgggcugaaccgccucucaaugcgagcgccuccgaucagggggagaaagugauucccccugcuggacaaaccgaagacgccgagcccaucagcgagccggaaaagguugagacgggcucugaaccuggggauacagagccccuggaacugggcggaccuggcgccgagcccgagcagaaggaacaguccaccgggcaaaaacgcccccuuaagaacgacgagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6750 - RNA, 2475 nt, Artificial Sequence
  mRNA product Design5 comprising derived and/or modified sequence from Homo sapiens__NP_005339.3 __HsHSP90AA1 (opt5)
gggagagucccgcagucggcguccagcggcucugcuuguucgugugugugucguugcaggccuuauucaagcuuaccaugcccgaggaaacccagacacaagaccagcccauggaggaagaggaaguggagacguucgccuuucaggcugagaucgcccagcugaugagccucauuaucaacaccuucuacuccaauaaggaaauuuuucugagagagcuuaucucuaacagcuccgaugcgcuggacaaaauucgguaugaaucucucacagauccgagcaagcuggacuccggcaaagagcuucacaucaaucugauccccaacaagcaagaucgcacccucacaauugucgacaccgggaucggaaugacaaaagcugaucugauuaauaaccugggcaccaucgccaagucugggacgaaggccuucauggaggcucuccaggccggagcugacauuagcaugaucggccaguuugggguuggauucuacuccgccuaucugguggcggaaaaagugaccgucauuacaaagcauaaugaugacgagcaguacgccugggaaagcucugcuggcggcuccuuuaccgugagaacagauaccggggagccuaugggacggggcacgaaaguuauccuucaccugaaggaagaccaaacagaguaucucgaggaacgcagaaucaaagagauugugaagaagcauagccaguucaucggguaccccauuacccuguuugucgaaaaagagcgggauaaggaagugucugacgacgaggccgaggaaaaagaggauaaggaagaggaaaaagagaaggaggaaaaagaguccgaagacaagccugagaucgaggauguuggaagcgacgaagaggaagagaagaaagauggcgacaagaaaaagaaaaagaagauuaaagaaaaguauaucgaucaggaggagcuuaacaaaacaaagcccaucuggacccgcaauccugacgauauuaccaacgaagaguacggggaguucuacaaaucucugacaaaugacugggaggaucaccucgcugugaagcauuuuuccgucgaaggacagcuggaguucagagcccugcucuuugugccgcggcgcgcgcccuucgaccuguucgagaacagaaagaaaaagaauaacaucaaacuuuaugugcggcgcgucuuuauuauggacaauugcgaagaacugaucccugaauaccucaacuucauuagaggcguuguggauagcgaggaccugccccuuaacaucucccgggaaaugcugcaacagucuaagauccucaaagugauucgcaagaaucuggucaagaaaugucuggagcucuuuacggagcuggccgaagauaaggagaacuauaaaaaguucuacgaacaguuuagcaaaaauaucaaacuuggcauucacgaggacucccaaaacagaaagaagcugagcgagcuccugcgguauuacaccucugcuuccggggaugaaauggugagccuuaaggacuauugcacaagaaugaaagagaaucagaagcacaucuacuacauuaccggagaaacaaaagaucagguugccaacucugcuuucguggagcgccugcggaagcauggccucgaagucaucuauaugauugagccuaucgacgaguacugugugcagcaacugaaagaauuugaggggaagacccugguuagcgugacgaaggaaggacucgagcugcccgaagaugaggaggagaaaaagaaacaggaagaaaagaaaacaaaguucgagaaucuuugcaagaucaugaaagacauucuggaaaagaaagucgagaagguggucguguccaacagacucguuaccucuccguguugcaucgugaccagcacauauggcuggaccgccaauauggagcgcauuaugaaagcccaggcucugcgggauaacuccacaaugggguacauggcggccaagaagcaccuggaaaucaauccugaccauagcauuaucgagacgcuuagacagaaagcugaagccgauaagaacgacaaaucugucaaggaccucgugauccugcuguaugagaccgcccuccuguccagcggauuuucucuugaggauccccaaacacacgcuaaucgcauuuaccggaugaucaaacugggccucggcauugacgaagaugacccuaccgccgaugacacauccgcggcuguuaccgaggaaaugccuccccuggagggggaugacgauacgagcagaauggaagagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6751 - RNA, 615 nt, Artificial Sequence
  mRNA product Design5 comprising derived and/or modified sequence from Homo sapiens__NG_005218__HsHSP90AA3P (opt5)
gggagagucccgcagucggcguccagcggcucugcuuguucgugugugugucguugcaggccuuauucaagcuuaccauggacagcuccaagcuggauucuggcaaagggcuccacaucaaccuggugcccaauaagcagaaccaaacccuuacaauugucgacacgagaaucggaaugaccaaaacagaucugauuaauaaccucggcaccguuacaaagagcgggaccaaagccuucauggaggcucugcaggccgacgcggauaucuccaugauuggacauuuuggcgugggguucuacucugcuuaucuuguggccaagaaggucacagugaucagcaaacacaauaacgacgaacaguacaccugggaguccucugccggaggcagcuuuacgguucggaccgaugaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6752 - RNA, 2451 nt, Artificial Sequence
  mRNA product Design5 comprising derived and/or modified sequence from Homo sapiens__NP_031381.2__HsHSP90AB1 (opt5)
gggagagucccgcagucggcguccagcggcucugcuuguucgugugugugucguugcaggccuuauucaagcuuaccaugcccgaggaagugcaccauggcgaggaagaggucgaaaccuucgccuuucaggcugagaucgcccaacugaugagccucauuaucaacacauucuacuccaauaaggagauuuuucugagagaacuuaucucuaacgcgagcgacgcucuggauaaaauucgguaugagucccucacggacccuucuaagcuggauagcgggaaagaacuuaagaucgacaucauuccgaauccccaggagcgcacccugacacucguugauaccggaaucggcaugacaaaagccgaccugauuaacaaucuggggaccaucgccaaguccggaacaaaggcuuucauggaggcccuccaggcuggcgccgauauuucuaugaucgggcaguuuggagugggcuucuacagcgcguaucugguggccgaaaaagucgugguuauuaccaagcacaacgacgaugagcaauacgcuugggaauccagcgccggcgggucuuuuacggugagagcugaccauggagagccuaucggccgggggaccaaagucauccuucaccugaaggaagaucagacagaguaucucgaggaacgcagagugaaagagguugugaagaagcauucccaguucauuggauaccccaucacccuguaucuugaaaaagagcgggaaaaggagauuagcgacgaugaggccgaagaggaaaaaggcgagaaggaagaggaggacaaagacgaugaagagaagccuaaaaucgaagacgucgggucugaugaggaggacgauuccggaaaggacaagaaaaagaaaacaaagaaaauuaaggaaaaguacaucgaucaggaggaacugaauaaaaccaagcccaucuggacgcgcaacccugacgauauuacacaagaggaauacggcgaguuuuauaaaagccucaccaaugacugggaggaucaccuggcggugaagcacuucucuguggaaggccagcuggaguuuagagcccuccuguucaucccgcggcgcgcucccuuugaccuuuucgaaaacaaaaagaagaaaaauaacauuaagcuguacgucagacggguuuucaucauggacuccugcgaugagcucauuccugaauaucugaauuuuauccgcggggugguggacagcgaggaucuuccccugaacaucuccagagagaugcuccagcagucuaaaauucugaaggucauccggaaaaauauugugaagaagugucuggaacucuucagcgagcuggccgaagacaaagagaacuacaagaaauuuuaugaggcuuucuccaagaaccuuaaacugggaauccaugaggauagcacaaaucgcagacggcucucugagcugcuuagauaccacaccucccaaagcggcgacgaaaugaccucucugagcgaguauguuucccgcaugaaggaaacacagaaaucuauuuacuacaucacgggggagagcaaggaacagguggccaacuccgccuuugucgaacgggugagaaagcgcggauucgagguuguguauaugaccgaaccuauugaugaguacugcguccaacagcucaaagaauuugacggcaagagccuggugucugucacaaaagaggggcuggagcuccccgaagaugaggaagagaagaaaaagauggaagaguccaaggcuaaauucgagaaucuguguaaacuuaugaaggaaauccuggacaagaaaguggagaagguuaccaucagcaaccggcucgugucuuccccgugcuguauugucacaagcaccuauggauggacggcgaauauggaaagaaucaugaaggcccaggcucugcgcgauaacuccacaaugggcuacaugauggccaaaaagcaucuggagauuaauccugaccaccccaucguggaaacccuucggcagaaagccgaggcugauaagaacgacaaagccguuaaggaccucgugguccugcuguuugagaccgcgcuccugucuagcggcuucucccuugaagauccucaaacacacucuaauagaauuuaucgcaugaucaagcuggggcucggaaucgacgaggaugaaguggcugccgaggagcccaacgccgcugugcccgacgaaauuccuccgcuggagggcgaugaagacgccagccggauggaggaaguugauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6753 - RNA, 2688 nt, Artificial Sequence
  mRNA product Design5 comprising derived and/or modified sequence from Homo sapiens__NP_003290.1__HsHSP90B1 (opt5)
gggagagucccgcagucggcguccagcggcucugcuuguucgugugugugucguugcaggccuuauucaagcuuaccaugagagcccugugggugcucggccugugcuguguccuucugaccuucgggagcguucgggcugacgaugagguggacguggauggaacagucgaagaggaccucggcaagucccgcgaagggucuagaacggaugacgaggugguucagcgggaagaggaggccauccaacuggauggacuuaacgcgagccagauucgcgaacugagagagaaauccgaaaaguuugcuuuccaggccgaggugaaucggaugaugaaacucaucauuaacucucuguacaagaauaaagagaucuuucugcgcgaacucauuagcaacgccuccgacgcucuggauaagaucagacuuaucucucugaccgacgagaaugcccucagcggcaacgaagaacugacagucaagauuaaaugcgauaaggagaaaaaucuucugcacgugaccgacacagggguuggaaugacccgggaggagcucgugaagaaccugggcacaaucgcuaaauccggcaccagcgaguuccugaauaagaugacggaggcccaggaagaugggcaaucuaccuccgagcucauuggacaguuuggcgucggguucuauagcgcguuucugguggccgacaaggugaucgucacaucuaaacauaacaaugacacccagcacauuugggaauccgauagcaacgaguucucuguuaucgcugacccccgcggaaauacacuuggcagagggaccacgauuacacuggugcucaaggaggaagccuccgauuaccuggagcuugacaccaucaaaaaccuggugaagaaauauagccaguuuaucaauuucccuauuuacgucugguccucuaagacagaaaccguggaggaaccgauggaggaggaagaggcugccaaagaagagaaggaggaaagcgaugacgaggcggccguugaagaggaagaggaggaaaagaaacccaagaccaaaaagguggagaaaacagucugggauugggaacucaugaacgacaucaagccuauuuggcaacggcccuccaaggagguggaagaggaugaguauaaagccuuuuacaagagcuucucuaaagaauccgacgauccuauggcuuauauccauuuuacggcugagggagaaguuaccuucaagagcauucuguucgugcccacaucugccccucgcggccuguuugacgaguacggcagcaaaaaguccgacuacaucaagcucuaugucagacggguguucaucaccgaugacuuucacgauaugaugccgaaauaccugaacuucgucaagggggugguugacucugaugaccuuccccugaaugugagccgcgaaacacuccagcagcauaaacugcuuaaggucauucggaaaaagcuggugagaaagacccucgauaugaucaaaaagauugccgacgauaaauauaacgacacguuuuggaaggaguucggaacaaauaucaaacugggcguuauugaggaucacuccaacagaacccgccuggcuaagcuccugcgguuucagagcucucaccauccuaccgacaucacaucccuugaucaauacguggaaagaaugaaagagaagcaggacaagaucuauuucauggcggggagcucucgcaaagaagccgaguccagccccuuugucgagcggcugcucaagaaaggauacgaagugauuuaucugaccgagccuguggacgaauacuguauccaggcucugcccgaguucgauggcaagagauuucaaaauguugccaaagaaggggucaaguucgacgaguccgagaagacaaaagaaucucgcgaggccguggaaaaggaguuugaaccgcuucucaacuggaugaaagauaaggcucugaaagacaagauugagaaggccguggucagccagcggcugacggaguccccuugcgcgcucguggcuucucaguacggauggagcggcaauauggaaagaaucaugaaagcccaggccuaucaaaccggcaaggauauuuccacaaacuacuaugcuagccagaaaaagaccuucgagaucaauccccgccacccucugauucgggacaugcuuagacgcaucaaagaagaugaggacgauaagacaguucuggaccucgccgugguccuguucgaaaccgcuacgcugcggucuggguaccuucuccccgauaccaaggccuauggagacagaaucgagcggaugcugcgccugucccucaacauugaucccgacgcgaaaguggaggaagaaccugaagaggagccggaagagacagccgaagacaccacagaggauaccgaacaggacgaggaugaggaaauggacguuggcacggaugaggaagaggaaacagcuaaggagagcaccgccgagaaagacgaacugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6754 - RNA, 2391 nt, Artificial Sequence
  mRNA product Design5 comprising derived and/or modified sequence from Homo sapiens__NP_057376.2__HsTRAP1 (opt5)
gggagagucccgcagucggcguccagcggcucugcuuguucgugugugugucguugcaggccuuauucaagcuuaccauggccagagagcugcgggcucuccugcuuuggggccgcagacugcggccccuccugcgcgccccugcgcuugcugccgugcccgggggaaagccgauccugugcccuagacggaccacagcccagcucggcccccgcagaaacccugcuuggagccugcaagccgggcggcuguucuccacgcagaccgcugaagacaaagaggaaccccuccacucuauuaucagcuccacagagucuguccagggaagcaccuccaagcaugaauuucaggccgagacaaagaagcugcuugauauuguugcgcgcucucuguacagcgagaaagaaguguucaucagagagcucauuuccaaugccagcgacgcucuggaaaaacuucggcacaagcuggugucugauggccaagcccucccugagauggagauccaucugcagaccaacgcugaaaaagggacaaucaccauucaggacacgggaaucggcaugacccaggaggaacuggucuccaaucucggcacaauugcccgcagcgggucuaaggcguuucuggaugcccuucaaaaccaggcugaggccuccagcaaaaucauuggacaguucggcgugggguuuuauucugcuuucaugguugccgacagaguggaagucuacucccggagcgccgcuccgggaucccugggcuaucaguggcucucugaugggagcggaguguuugagaucgcggaggccuccggcguucgcaccggcacaaagauuaucauccaccugaaaagcgacuguaaggaguucucuuccgaggcuagagugcgggaugucgugaccaaguacagcaauuuugugucuuucccccuuuaucugaacgggagacgcaugaauacgcuccaagccauuuggaugauggacccuaaagauguccgggaauggcagcaugaggaauuuuacagauauguugcccaggcucacgacaagccccgcuacacacugcacuacaaaaccgaugccccucugaacauccggagcauuuucuaugugcccgacaugaagccguccauguuugacgugucuagagagcucggaagcuccgucgcgcuguacagccgcaaagugcuuauccaaacaaaggcuaccgauauucugccuaaauggcuccgguucaucagaggcguuguggacucugaggauaucccccugaaucuuucccgcgaacugcuccaggagagcgcccugauucggaagcugagagacguccuccagcagcgccugaucaaguucuuuauugaucaaucuaaaaaggacgccgaaaaauaugcuaaguucuuugaggauuacgggcuuuucaugcgggaaggaaucgugaccgccacagagcaggagguuaaagaagacauugcuaagcugcucagauaugaguccagcgcccugccuuccggccagcugacgucucuuagcgaauacgcgucccggaugcgcgccgggaccagaaacaucuauuaccucugcgcucccaaucggcaucuggccgagcacucucccuacuaugaggcuaugaagaaaaaggauacagaagugcuguuuuguuucgagcaguuugacgaacucacccugcuucaucugagagaguucgauaaaaagaaacucaucagcgucgaaacagacauuguggucgaccacuacaaggaggagaaguuugaagaucgcuccccugccgcggagugccugagcgaaaaagagaccgaagaacugauggccuggaugcggaacgugcuuggaucuagaguuacgaaugugaaggucacacuccgccuggacacccacccggcuauggugaccguucuggagaugggcgccgcuagacauuuccuccggaugcaacagcuggccaaaacacaggaggaacgcgcccagcuucugcaacccacccucgaaaucaacccuagacacgcucugauuaagaaacugaaucagcuucgggcguccgagcccggccucgcccagcugcugguggaucagaucuaugaaaacgcuaugauugccgccgggcucgucgacgauccucgcgcuauggugggaagacugaacgagcuucuggugaaggcccucgagcggcauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6755 - RNA, 738 nt, Artificial Sequence
  mRNA product Design5 comprising derived and/or modified sequence from Homo sapiens__NP_000609.1__HsIGF1 (opt5)
gggagagucccgcagucggcguccagcggcucugcuuguucgugugugugucguugcaggccuuauucaagcuuaccaugggcaagaucagcucccugcccacccagcuuuucaaaugcuguuuuugcgacuuccugaaggugaaaaugcacacaaugucuagcucccaucucuuuuaccuggcccucugucugcuuacguucaccucuagcgcuacagccgggccugagacccugugcggagcggaacucgucgaugcucugcaauuuguuuguggcgacagaggguucuauuuuaacaagccgacaggauacggcuccucuagccggcgcgcuccccagaccgggauuguggaugagugcuguuucagauccugcgaccugcggcgccucgaaauguauugugccccucugaaacccgccaagagcgccagaucugugcgggcucagcgccacacagauaugccuaagacccagaaagagguccaucuuaagaaugccuccagaggaagcgcgggcaacaaaaauuaccggaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6756 - RNA, 819 nt, Artificial Sequence
  mRNA product Design5 comprising derived and/or modified sequence from Homo sapiens__NP_000603.1__HsIGF2 (opt5)
gggagagucccgcagucggcguccagcggcucugcuuguucgugugugugucguugcaggccuuauucaagcuuaccaugggcauccccaugggaaagagcaugcuggugcuccugaccuuccuugccuuugcuuccugcuguauugccgcguacagaccuucugagacacugugcgggggcgaacucgucgacacgcugcaguucguuuguggggaucggggauuuuauuucagccgcccggcuuccagagugucucggcgcagcagaggcaucguggaggaaugcuguuuucgguccugcgaccuugcccugcucgagaccuacugugccacacccgcuaaaucugaacgcgaugucagcaccccucccacagugcugccugacaacuuccccagauauccuguugggaaguuuuuccaauacgauaccuggaaacaguccacacagcggcugcgcagaggacucccggcccugcuucgggcucgcagaggccacgugcuggccaaggagcucgaggcguuucgggaagccaaacgccauagaccccugauugcccuuccuacccaggaccccgcucacggcggggcuccucccgagauggccagcaaucggaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6757 - RNA, 915 nt, Artificial Sequence
  mRNA product Design5 comprising derived and/or modified sequence from Homo sapiens__NP_000591.1__HsIL6 (opt5)
gggagagucccgcagucggcguccagcggcucugcuuguucgugugugugucguugcaggccuuauucaagcuuaccaugaacagcuucuccaccucugccuuuggccccguggcuuucagccuggggcuccugcuuguccugccugccgcguuuccggcucccguuccucccggagaggacuccaaggauguggccgccccucacagacagccccucacaucuagcgaacggaucgacaaacaaauucgcuacauccuggauggcauuuccgcucuuagaaaggagacgugcaauaaaucuaacaugugugaaagcuccaaggaggcccuggcugaaaauaaccucaaucugccuaaaauggccgagaaggacgggugcuuccagagcggauuuaacgaggaaaccugucuggugaagaucauuacaggccuccuggaguucgaagucuaucuugaguaccugcagaaucgguuugagucuuccgaagaacaggcgcgcgccgugcaaaugagcaccaaaguucucauccaguuccugcagaagaaagcuaagaaccuugaugccaucacaaccccggaccccacaaccaaugcuucucugcucacgaaacugcaggcccaaaaccaguggcugcaggauaugaccacacaucucauucugagauccuuuaaggaguuccuucagagcucucugcgggcgcuccgccaaaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6758 - RNA, 1557 nt, Artificial Sequence
  mRNA product Design5 comprising derived and/or modified sequence from Homo sapiens__NP_002183.1__HsINHBA (opt5)
gggagagucccgcagucggcguccagcggcucugcuuguucgugugugugucguugcaggccuuauucaagcuuaccaugccccugcucuggcugagaggcuuccuucuggccagcugcuggaucauugugcgguccucuccuaccccggggagcgagggacacuccgcugcccccgacuguccuucuugcgcgcucgcugcccugcccaaggaugucccuaacagccagcccgaaaugguugaggccgugaaaaagcauauccuuaauaugcugcaccucaaaaagcgcccugacgugacacaaccgguccccaaagcugcccugcugaacgcuauuagaaagcuccaugugggcaagguuggggaaaauggauacguggagaucgaagaugacauuggccggcgcgccgagaugaacgagcugauggaacagacguccgagaucaucaccuuugcggaaucugggacagccagaaaaacccuucacuucgagauuagcaaggagggauccgaucugagcgucguggaacgggcugagguuuggcucuuucugaaagugccuaaggccaaucgcacaagaaccaaagucacaauccggcuuuuccagcagcaaaagcauccccagggcucucuggacaccggcgaagaggcugaagagguggggcucaagggagagcgcuccgaacugcugcucagcgagaaaguggucgaugccagaaagucuacguggcacguuuuuccuguguccagcucuauucagcggcugcuugaccagggcaaauccagccuggaugugcgcaucgcgugugaacaaugccaggaguccggggccucucucguccugcuuggaaagaaaaagaaaaaggaagaggagggcgaagggaagaaaaagggaggcggcgaagggggagcuggcgccgacgaggagaaagaacagagccacagacccuuccugaugcuccaggcucggcaauccgaggaucauccgcaccgcagacggagacgcgggcuggagugugacggaaaggugaacauuugcuguaaaaagcaguuuuucguuagcuuuaaggauaucggcuggaaugacuggauuaucgccccuucuggguaucaugccaacuacugcgaaggagagugucccucccacaucgcuggcaccagcggcucuagccuguccuuccacucuacagugauuaaucauuaucggaugagagggcacagcccuuuugcgaaccucaaauccugcuguguccccaccaagcugcgccccaugagcaugcuuuacuaugacgauggacagaauaucauuaaaaaggacauccaaaacaugauuguggaagagugcggcugcucuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6759 - RNA, 1500 nt, Artificial Sequence
  mRNA product Design5 comprising derived and/or modified sequence from Homo sapiens__NP_002184.2__HsINHBB (opt5)
gggagagucccgcagucggcguccagcggcucugcuuguucgugugugugucguugcaggccuuauucaagcuuaccauggacggccugcccgggagagcccucggagcugccugccugcuucugcucgcggcuggcuggcuggggccugaggccuggggaagcccgacacccccucccaccccugccgcucccccuccgcccccucccccuggcucccccgggggaucucaggauacguguaccagcugcggcggcuuccggcgcccggaggaacuugggagaguggacggagauuuucuggaagccgucaagcggcacauccucucccgccugcaaaugagaggccggccuaacauuacacaugcuguucccaaagccgcgauggugaccgcccugcgcaagcuccacgcugggaaagugagagaggacggacgggucgaaaucccucaucuggauggccacgccucucccggggcugacggacaggagcgcgugagcgagauuaucuccuucgccgaaacagauggccuugcgucuagcagaguucggcuguacuuuuucauuuccaaugagggcaaccagaaucucuuugugguccaggccagccuguggcuuuaucugaagcuccugcccuacgugcuggaaaaagggucucgcagaaagguucgggugaaggucuauuuccaagagcagggacauggcgaccgcuggaacaugguggagaaaagaguggaucucaagcgguccggguggcacaccuuuccucugacagaagcuauccaggcccuuuucgagagaggagaacgccggcugaaucucgacguccagugugauagcugccaagagcuggcuguugugccgguguuugucgaccccggcgaagagucucacagaccuuucgugguugugcaggcccgccuuggggauucccggcauagaauccgcaaacggggacuggagugugacggcagaaccaaccucugcugucgccagcaguuuuucauugacuuucggcugaucggcuggaaugauuggauuaucgcccccacgggguacuauggaaacuacugcgaaggcagcuguccugcuuaucuggcggggguccccggaucugccuccagcuuccacaccgcugugguuaaucaauacagaaugcgcggccucaacccggggacagucaauuccugcuguauuccuaccaagcugucuacaaugagcaugcuuuacuucgacgaugaguauaacaucgugaaacgggacgugcccaauaugauugucgaagagugcggcugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6760 - RNA, 3735 nt, Artificial Sequence
  mRNA product Design5 comprising derived and/or modified sequence from Homo sapiens__NP_000623.2__HsITGAM (opt5)
gggagagucccgcagucggcguccagcggcucugcuuguucgugugugugucguugcaggccuuauucaagcuuaccauggcccugagagugcuccugcuuaccgcucugacacucugccacggcuucaaccuggacacggagaaugccaugaccuuucaggaaaacgcgcggggguucggacaaagcgugguucagcuucagggcucccgcgugguggucggggcuccccaggagaucguggccgccaaucaaagaggaucucuguaccagugugauuauagcacaggcuccugcgaaccuauucggcuccagguuccgguggaggcugucaacaugucucuggggcugagccucgccgcuaccacauccccuccucagcugcuugccuguggacccaccgugcaucaaacaugcucugaaaauaccuacguuaagggccuguguuuucucuucggcagcaaccugcgccagcagccucagaaauuucccgaggcgcuuagagggugcccucaagaggacuccgauaucgccuuccugauugacggaagcggcucuaucauuccgcacgauuuucggcgcaugaaggaguucguguccacggucauggaacagcucaaaaagagcaaaacccuguuuucucugaugcaguauuccgaagaguucagaauccauuuuacauucaaggaguuucaaaauaaccccaauccucggagccucgugaagcccaucacccagcugcuugggcgcacacacaccgcuacgggaauuagaaaagugguccgggaacuguucaacaucacaaauggcgcccgcaagaacgcuuucaaaauucucguugugaucaccgacggggagaaguuuggagauccucugggcuacgaagacgugauucccgaggccgauagagaaggcgucauccgguaugugauugggguuggagacgcguuccgcucugagaaauccagacaggagcuuaauacaaucgccagcaagccgccucgggaucauguguuucaggucaacaauuucgaagcucugaagaccauccaaaaccagcucagagagaaaauuuuugccaucgaaggcacccagacaggguccucuagcuccuucgagcacgaaaugagccaggagggauuuucugcugccauuacguccaacggcccccugcugagcaccguggggucuuacgacugggccggaggcguuuuccucuauacaagcaaggagaaauccaccuuuaucaauaugacacgcguggauucugacaugaacgacgcuuaccugggcuacgcggccgcuauuauccuucggaauagaguccaaagccuggugcucggggccccucgcuaucagcacaucggacuggucgccauguuccggcagaacaccggcaugugggaauccaaugcuaacgugaaggggacgcagauuggagccuacuuuggcgcgagccuuuguucuguugauguggacuccaaugggagcacagaucugguccucaucggcgcuccccauuauuacgagcaaaccagaggaggccaggugucuguuugcccccugccucgcgggcgggccagauggcagugugacgccgugcuguauggagaacagggccaaccgugggggcgcuucggagcugcccucaccguccugggcgaugugaacggggacaaacuuacagauguggcuauuggcgcccccggagaggaagacaaucggggcgcgguuuaccuguuucacgggaccuccggaagcggcaucuccccuucucauagccagagaauugccggguccaagcucucuccccgccugcaguauuucggacaaagccuguccggcgggcaggaucuuacaauggacggccucgucgaucugacggugggagcucagggccacgugcugcuccugcggagccagccuguccuuagagugaaagccaucauggaguucaacccccgggagguugcucgcaauguguuugaaugcaacgaccaagucgugaaggggaaggaggccggagaaguuagagugugucugcacguccagaaaucuacccgggacagacuccgcgagggccagauccaguccgugguuacauacgaucuggcgcuggacagcgggcggccgcauucuagagccguguucaaugagaccaagaacuccacacgcagacaaacccagguccuuggacucacgcagaccugcgaaacacugaaacugcagcucccuaauugcauugaggaucccgugagcccuaucgugcugcggcuuaacuuuucucuggucggcacaccccucagcgcuuucgggaaccugcgcccuguucuggccgaagacgcucaaagacuuuuuaccgcccucuuccccuuugagaagaauuguggcaacgauaauauuugccaggacgaucuguccaucaccuucagcuuuaugucucuggacugucucguggugggaggcccgcgggaguucaacgucacggugacaguucgcaaugauggggaagacuccuacagaacccaggugacauuuuucuuuccucuggaucuuagcuaucggaaagucuccacccugcaaaaccagcgcucucagagaagcuggcggcucgccugcgaguccgcuucuagcaccgaaguguccggagcgcugaagucuacaagcuguuccauuaaucaccccaucuuccccgagaacagcgaaguuacguucaauauuaccuuugacguggauucuaaggccucccugggcaacaaacuucuccugaaggcuaaugucacaagcgagaacaauaugccucgcaccaacaaaacagaguuccagcuggaacucccggugaaguacgccguuuauaugguggucaccucucaugggguguccacgaaauaccugaauuuuacagccagcgagaacaccucuagagugaugcaacaccaguaucaggucuccaaccuuggacagcggagccugcccaucucccucguuuuccuggugccugugagacugaaucaaaccgucaucugggaccgcccccaggugacauuuagcgaaaaccuuucuagcacaugccauaccaaggagcggcugccuucccacucugacuuccucgcugaacugagaaaggcccccguugugaauuguagcauugcggucugccagcgcauccagugugauauucccuuuuucggcauccaagaggaauuuaacgcuacgcucaaaggcaaucuguccuucgacugguacauuaagaccucucacaaccaucuucugaucgugagcacagccgagauccucuuuaaugauuccguuuucacccugcugcccgggcagggagccuucgugcggucucagacagagaccaaagucgaaccguuugaggugccuaacccccuuccucugauugucggcagcuccgucgggggacuccugcuccuggcucuuaucacggccgcgcuguauaagcucggcuucuuuaaaagacaguacaaggacaugaugagcgaagggggacccccgggcgcugagccucaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6761 - RNA, 1680 nt, Artificial Sequence
  mRNA product Design5 comprising derived and/or modified sequence from Homo sapiens__NP_002415.1__HsMMP8 (opt5)
gggagagucccgcagucggcguccagcggcucugcuuguucgugugugugucguugcaggccuuauucaagcuuaccauguucagccugaagacccuccccuuucugcuucugcuccacgugcagaucuccaaagccuucccugucucuagcaaggagaaaaacacaaagacgguucaagacuaccuggaaaaauuuuaucagcuuccguccaaucaguaccagucuaccagaaagaacggcacaaaugugauuguggagaagcugaaagaaaugcaacgguucuuugggcucaacgucaccggaaagcccaaugaggaaacacuggauaugaugaaaaagccucgcugcggcgugcccgacagcgggggauucaugcugaccccuggcaaccccaaaugggagagaacaaaucucaccuaucggauccgcaacuacacgccucagcuguccgaggcugaaguugagagagccauuaaggaugcguuugaacuuuggucuguggcuagcccgcugaucuucacccggauuucccagggggaggccgacaucaauaucgccuuuuaucagcgcgaucauggagacaacagccccuucgauggcccuaauggcauucucgcucacgccuuucaacccgggcagggaaucggcggggacgcucauuucgaugccgaggaaacauggaccaacacaucugcgaauuacaaccuguuucuugucgccgcucacgaguucggacauucccugggccucgcccacagcucugacccuggggcucugauguaucccaauuacgccuucagagaaaccuccaacuacagccugccgcaggaugacauugauggaauccaggcgauuuauggccucucuuccaacccuauccaacccacgggcccuagcacacccaagcccugugacccuucccugaccuuugacgccauuacaacccuucggggagagauccuguucuuuaaagaucgcuacuucuggagacggcacccgcagcuccagcgcguggaaaugaauuuuaucucucuguucuggcccagccuuccuaccgggauucaagcugccuaugaggacuuugauagagaccugaucuuccucuuuaagggcaaccaguacugggcucuguccggguaugauauucugcagggauaccccaaagacaucagcaauuauggcuucccuucuuccguucaggccauugaugccgcuguguuuuaccggagcaagacauacuucuuugucaacgaccaauucuggcgcuaugauaaucagagacaguucauggagcccggguacccgaaaucuaucagcggagcguuuccuggcaucgaauccaagguggacgccguguuccagcaagagcacuuuuuccaugucuuuucuggcccccgguauuacgcuuucgaucucauugcccagagaguuacgcgcguggcccgggggaacaaauggcugaauugcagauauggaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6762 - RNA, 2400 nt, Artificial Sequence
  mRNA product Design5 comprising derived and/or modified sequence from Homo sapiens__NP_004985.2__HsMMP9 (opt5)
gggagagucccgcagucggcguccagcggcucugcuuguucgugugugugucguugcaggccuuauucaagcuuaccaugagccuguggcagccccucgugcugguccuucugguucucggcugcuguuucgccgcuccuagacaacggcaguccacccuggugcuuuuuccgggggaccugcgcacaaaccucacggauagacagcuggccgaggaauaccuguaucgguacggauauacccgcguggcggagaugagaggcgaaucuaaaagccucgggcccgcucugcuucugcuccagaaacaacugucccuuccugagacaggagaacuggacucugccacccucaaggccaugcggacaccccgcugcggcgucccugaucuggggagauuccagaccuuugagggagaccugaaauggcaccaucacaauaucacauacuggauucagaacuauagcgaggaucucccccgggcugugaucgacgaugccuucgcucgcgccuuugcgcugugguccgccguuaccccucuuacguucaccagaguguacucucgggacgcugauauugucauccaguuuggcguggccgaacauggcgacggguauccguucgauggaaaggacggccugcucgcucacgccuuucccccugggcccgggauucaaggcgaugcgcauuucgacgacgaugagcuguggagccuugggaaaggaguuguggucccuacacgcuuuggcaaugccgacggcgcugccugucacuuccccuuuaucuucgaagggagauccuacagcgcuugcaccacagauggacggucugacggccugccgugguguuccaccacggccaacuacgauacagacgaucgcuucggguuuugcccuagcgagagacucuauacccaggacggaaaugccgauggcaagcccugucaguucccuuuuaucuuccaggggcaaucuuacuccgcuugcacaaccgacggacggagcgauggcuauagauggugugcgaccacagccaacuacgaccgcgacaagcuguuuggcuucugccccacgcgggcugauucuaccgugaugggaggaaauuccgccggcgagcuguguguguuucccuucacauuucucgggaaagaauauagcacaugcaccuccgagggaagaggcgacgggcgccuguggugcgccaccacgucuaacuucgauagcgacaagaaauggggcuuuuguccugaucagggauacucccuuuuccuggucgcugcccacgaauuuggccaugcgcucgggcuggaccacagcucuguuccggaggcucuuauguaucccauguaccgguucacagaaggaccuccccugcauaaggaugacgugaauggcauuagacaccucuacgggccucgccccgagccggagccucggcccccuaccaccacaacaccccagccuaccgcgcccccgacggugugcccuaccggaccucccacaguccaccccuccgaaagaccgaccgccggccccacagggccucccagcgcuggcccuaccggacccccuacggccggccccucuaccgcuacaaccgugccgcugagcccuguugaugacgccuguaacgugaauaucuucgaugcgauugccgagaucgggaaccaacuguaucucuuuaaagacggaaaguacuggcgcuucuccgaaggccgggggucuagaccccagggaccuuuucugauugcugauaaguggcccgcccuuccgcgcaaacuggacagcgucuucgaggaacggcucuccaagaaacuguuuuucuuuagcggcagacagguguggguuuauacaggggcuucugugcugggcccucggcgccuugacaagcucggacugggcgccgaugucgcccaggugaccggggcccugagauccggacggggcaaaaugcuccuguucagcgggagacgccuuuggcgguuugacgucaaggcucaaaugguggaucccagaucugccuccgagguugaccgcauguucccuggagugccccuggauacgcaugacgucuuucaguacagagagaaggcuuauuucugccaggaucgguuuuacuggcgcgugagcuccagaucugaacucaaucagguugaccaagugggcuaugucacauacgauauccugcagugucccgaggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6763 - RNA, 1692 nt, Artificial Sequence
  mRNA product Design5 comprising derived and/or modified sequence from Homo sapiens__NP_002418.1__HsMMP13 (opt5)
gggagagucccgcagucggcguccagcggcucugcuuguucgugugugugucguugcaggccuuauucaagcuuaccaugcaccccggcgugcuggccgcuuuccucuuucugagcuggacccauugcagagcccuuccucugccguccgggggagacgaggaugaccucucugaagaggaucugcaguucgcggaacgguaccuucgcagcuauuaccaccccacaaaccuggcuggcauccucaaggagaaugccgccuccucuaugacggaaagacugcgggagaugcagagcuuuuucgggcuggaggucaccggaaaacucgacgauaacacacuggacguuaugaagaaaccucgcuguggcgugcccgaugugggggaauauaaugucuuuccuagaacccuuaagugguccaaaaugaaccugacauaccggauugugaauuauacccccgacaugacacauucugagguugaaaaggcuuucaagaaagccuuuaagguguggagcgaugucaccccucucaacuucacgcgccugcacgacggaaucgcugauauuaugaucuccuuuggcauuaaagagcauggcgacuucuacccguuugaugggcccagcggacuucuggcccacgcguucccucccggcccuaauuaugggggagacgcccacuuugacgaugacgagaccuggacaucuuccagcaagggcuacaaccucuuccugguggcugcccaugaguucgggcacucucugggacucgaucauuccaaagaccccggcgcucugauguuuccgaucuacaccuauacaggcaagagccacuucaugcuuccugaugacgauguucaagggauccagucucuguacggacccggcgacgaggauccuaaucccaagcaccccaaaaccccugacaagugcgauccgucccucagccuggacgccauuacgucccuuagaggggaaacaaugaucuuuaaagaccgguucuuuuggcgccugcauccccagcaaguggaugcggaacucuuccugaccaagucuuuuuggccugaacugcccaacagaauugacgccgcuuaugagcacccuagccaugaucucaucuucauuuuucggggacgcaaauucugggcccugaauggcuacgacauccuugagggguaucccaagaaaauuuccgaacugggacucccgaaggaggucaagaaaaucagcgcugccgugcacuuugaagauacaggcaagacccugcuuuucucuggcaaccagguguggagauacgacgauaccaaucauaucauggacaaagauuauccucggcugauugaggaagacuuucccgggaucggagauaaggucgacgccguuuacgagaaaaacggcuacauuuauuucuucaaugggccuauccaguuugaguacuccauuuggagcaaccgcaucgugagagugaugcccgcuaacucuauccucugguguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6764 - RNA, 1344 nt, Artificial Sequence
  mRNA product Design5 comprising derived and/or modified sequence from Homo sapiens__NP_001286.1__HsCCR1 (opt5)
gggagagucccgcagucggcguccagcggcucugcuuguucgugugugugucguugcaggccuuauucaagcuuaccauggagacccccaacacaacggaagacuacgauaccacaaccgaguucgacuauggcgaugccacaccuugccagaaggugaaugaaagagcuuuuggggcccaacugcucccgccccuguacagccuugucuucguuaucggacuggugggcaacauucucgugguccuggugcuuguucaguauaaacggcugaagaauaugaccuccaucuaccuccugaaccuggcgauuucugaccuccuguuucuuuucacacugccuuuuuggaucgauuauaaacucaaggacgauuggguguucggggacgcuauguguaaaauucugagcggauuuuacuauaccggccuuuacuccgagaucuucuuuaucauucugcucacgaucgaucgcuaccuggccauuguccacgccguguucgcucugagagcccggaccguuacauuuggggugaucaccucuauuaucauuugggcucucgccauccuggcgagcaugcccggacuuuauuucuccaagacacagugggaauuuacccaucacacgugcucucugcauuucccucacgagagccuccgcgaguggaagcuguuccaggcccuuaaacugaaucucuuuggccugguccugccccuccuggugaugaucauuuguuacacaggcaucauuaagauccuucugagacggccuaacgagaaaaaguccaaagcugugcgccucauuuucgucaucaugaucaucuuuuuccuguuuuggaccccguauaaucuuacaauucugauuagcguuuuccaagacuuucucuucacccaugaaugcgaacagucuagacaccuggaucuggccguccaggugaccgaggugaucgcuuacacacacuguugcgugaaccccguuauuuaugccuuugugggggagcgguuccgcaaguaccucagacagcuguuucaucggcgcgucgcggugcaccuuguuaaguggcugccuuuccucuccguggacagacuggaacgggucagcucuacgucccccagcaccggagagcaugaacugucugccggcuuuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6765 - RNA, 912 nt, Artificial Sequence
  mRNA product Design5 comprising derived and/or modified sequence from Homo sapiens__NP_002598.4__HsPDGFA (opt5)
gggagagucccgcagucggcguccagcggcucugcuuguucgugugugugucguugcaggccuuauucaagcuuaccaugagaacccuggccugccuccugcuucugggcuguggguaccucgcucacgugcuggccgaggaagcggagaucccccgggaagucauugagcgccuugcuagaagccagauccauuccauucgggaccugcaacgccuccuggaaaucgauucuguuggaagcgaggacucccuggauacaucucucagagcccacggcgugcaugccacgaagcacgugccugagaaacggccgcugcccauucgcagaaagcggagcaucgaagaggcugucccugccgugugcaaaacccgcacaguuaucuaugaaauucccagaucccagguggacccuaccucugcuaacuuccuuaucuggcccccuugugucgaggugaagcggugcacaggguguugcaauaccagcuccguuaaaugucagccgagccgcgugcaucacagaucugucaagguggccaagguggaguacguccggaaaaagcccaaacugaaggaaguucaggugcgccucgaggaacaccuggagugcgcgugugccacaaccucccuuaacccugauuauagagaagaggacacgggacggcccagagagagcggcaaaaagcgcaagcggaaaagacugaagccuaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6766 - RNA, 1002 nt, Artificial Sequence
  mRNA product Design5 comprising derived and/or modified sequence from Homo sapiens__NP_002599.1__HsPDGFB (opt5)
gggagagucccgcagucggcguccagcggcucugcuuguucgugugugugucguugcaggccuuauucaagcuuaccaugaacagaugcugggcccuguuccucagccuguguugcuaccuucggcugguguccgcugagggcgaccccaucccugaggaacucuaugaaaugcugucugaucacagcauucgcuccuuugacgaucuucagagacugcuccauggggacccgggagaggaagauggcgccgagcuggaccugaauaugacccggucucacagcgggggagagcucgaaucccuggcgcgcggcagacggucucuugggagccugacaaucgcugagcccgccaugauugccgaauguaagacgcgcaccgaggucuucgagaucuccagacggcucauugaucgcacaaacgcuaauuuucugguuuggccucccugcguggaagugcaaagauguagcggaugcuguaacaaucggaacguccagugccgcccuacccaggugcagcuuagacccguucaagugcggaaaaucgagaucguccgcaagaaaccuauuuucaagaaagccacagugacccuggaagaccaucucgcuuguaagugcgagacaguugccgcggccagaccggugacccggucucccggcggcucccaggaacagagagcuaagacgccucagacccgcgucacaauccggaccgugagagugcgccggcccccuaaagggaagcacagaaaauuuaagcauacacacgauaaaaccgcccugaaggagacgcugggagcuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6767 - RNA, 1314 nt, Artificial Sequence
  mRNA product Design5 comprising derived and/or modified sequence from Homo sapiens__NP_057289.1__HsPDGFC (opt5)
gggagagucccgcagucggcguccagcggcucugcuuguucgugugugugucguugcaggccuuauucaagcuuaccaugagccuguucggccuccugcuucugaccuccgcccucgcugggcagagacaaggaacacaggccgagucuaaccugagcuccaaguuucaguucucuagcaauaaagaacagaacggcgugcaagacccccagcacgagcggaucauuacggucuccaccaaugggucuauccauagcccucgcuuuccgcacacauaccccagaaacaccguucuuguguggcggcugguggcggucgaagagaauguguggauucagcucacauucgaugaacgcuuuggacuggaggacccugaggaugacaucugcaaguaugauuucguugaaguggaggaacccuccgacggcaccauucuggggagaugguguggaagcggcacagucccuggcaaacagaucucuaaggggaaccaaauccggauucgcuuuguguccgaugaguacuuccccagcgagccuggauuuugcauccauuauaauauuguuaugccgcaguucaccgaagcugugucucccuccguccucccucccagcgcccugccucuugaccugcucaacaaugccaucacggcuuuuucuacccuggaggaucuuauuagauaccuggaacccgagcgguggcagcucgaccuggaagaucuguaucgcccgacauggcagcuccugggcaaagccuucguguuugggagaaagucccggguggucgaccuuaaccugcucaccgaggagguucgccuguacagcuguacaccuagaaauuucuccgugucuauccgggaggaacuuaagcgcaccgauacgauuuucuggcccggaugccugcucgugaaaagauguggcgggaacugcgcuuguugccugcacaauuguaacgaaugccaaugugucccuagcaaggugaccaaaaaguaucaugagguucugcagcuccggcccaaaacaggagugagaggccugcacaagucccuuacagacgucgcccuggaacaccaugaggagugcgacugcgugugucgcggcagcaccgggggaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6768 - RNA, 1371 nt, Artificial Sequence
  mRNA product Design5 comprising derived and/or modified sequence from Homo sapiens__NP_149126.1__HsPDGFD (opt5)
gggagagucccgcagucggcguccagcggcucugcuuguucgugugugugucguugcaggccuuauucaagcuuaccaugcacagacugaucuucguguacacccucauuugcgccaacuuuuguagcugccgggacacauccgcuacgccccagucugccagcaucaaggcgcugcgcaaugcuaaccuuagacgggaugaccuguaucgcagagaugagaccauucaagucaaaggcaauggguacguucaguccccucgguucccgaacucuuauccccgcaaucuccugcuuacauggagacugcauagccaggaaaacacccggauccagcucguguuugacaaucaauucggacuggaggaagccgagaacgauauuugucgcuacgacuuuguggaagucgaggauaucuccgagacaucuaccaucauuagaggccgguggugcgggcacaaggaagugccuccccgcaucaaaagcagaacaaaucagauuaagaucaccuucaaauccgacgauuauuuuguugccaagccuggauucaagauuuacuauagccugcucgaggacuuucagcccgcugccgcuucugaaacgaacugggaguccgugaccagcucuaucuccggcgucagcuacaauucuccuuccgugacagauccgacccugauugccgacgcgcuugauaaaaagaucgccgaguucgacacaguugaagaccugcucaaauacuuuaaccccgagagcuggcaggaagaucuggagaauauguaucuugacaccccucgguaccgcgggagauccuaucaugaucggaagucuaaaguggaccuggauagacucaacgacgaugcuaagcgcuacagcuguacgccccggaauuauuccgucaacaucagagaggaacugaagcuggccaacgugguguucuuuccucgcugccuccugguccaacgguguggaggcaauugcggcugugggacaguuaacuggagaagcugcaccuguaauucuggaaaaacagugaagaaauaccacgaggugcuucaguucgaacccggccauauuaagcgccgggggagagcuaaaaccauggcccuggucgacauccagcucgaucaccacgagcgcugcgacugcauuuguuccagccggccgccuagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6769 - RNA, 954 nt, Artificial Sequence
  mRNA product Design5 comprising derived and/or modified sequence from Homo sapiens__NP_003946.3__HsSOCS3 (opt5)
gggagagucccgcagucggcguccagcggcucugcuuguucgugugugugucguugcaggccuuauucaagcuuaccauggugacccacagcaaguuccccgccgcuggcauguccagaccucuggacacaucucuccggcugaaaacguuuagcuccaagucugaguaccagcuugucguuaacgccgugcgcaaacugcaagaaagcggguucuauugguccgcggugaccggaggcgaggcuaaucuccugcuuucugccgaaccggccgggacauuucugaucagagauagcuccgaccagcggcauuucuuuacccucagcgucaagacacagucuggaaccaaaaaccugcgcauucagugcgagggcggguccuucagccugcaaucugaucccagauccacacagccugugccccgguuugacuguguucucaagcuggugcaccauuacaugccucccccuggagcuccgagcuuccccucuccucccaccgaaccuuccagcgagguccccgagcagccguccgcccagccucuucccggcucuccuccccgcagagcuuauuacaucuauagcggcggggaaaagauuccccuggugcucucccggccucugagcucuaauguugccacgcuucaacaccugugccgcaaaaccgugaacggacaucucgauuccuacgagaaggucacacagcugccgggccccaucagagaauuucuggaccaguaugaugcgccucucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6770 - RNA, 759 nt, Artificial Sequence
  mRNA product Design5 comprising derived and/or modified sequence from Homo sapiens__NP_003227.1__HsTGFA (opt5)
gggagagucccgcagucggcguccagcggcucugcuuguucgugugugugucguugcaggccuuauucaagcuuaccauggugcccagcgccggccagcuggcucucuucgcccuggggaucguccuugcggcuugccaagcccuggagaacuccaccucuccucucagcgccgacccgcccguugcugccgcuguggugucccacuuuaaugauuguccugacucucauacacaguucugcuuucacggaacguguagauuccugguccaggaagauaagcccgccugcgugugucauagcggcuacguuggggcgcggugcgagcacgccgaccuucuggcuguggucgccgcuucccagaaaaagcaagccauuaccgcgcucgugguugugucuaucgucgcccuggcugugcugauuaucacaugugugcucauucauugcugucagguccgcaaacacugcgaaugguguagagcccugaucugccggcacgagaagccuagcgcccuucugaaaggacgcaccgcuugcugucauuccgaaacaguugugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6771 - RNA, 1449 nt, Artificial Sequence
  mRNA product Design5 comprising derived and/or modified sequence from Homo sapiens__NP_000651.3__HsTGFB1 (opt5)
gggagagucccgcagucggcguccagcggcucugcuuguucgugugugugucguugcaggccuuauucaagcuuaccaugcccccuagcggccugagacuccugccgcuucugcucccccugcuuuggcugcucgugcugaccccugggcggcccgccgcuggacuguccacaugcaagacgaucgacauggagcucgucaaacgcaagagaauugaagccauccggggccagauucugucuaaacuucgccuggcgagcccucccucccaaggggagguuccuccgggaccccucccugaagcugugcuggcccuuuacaacucuaccagagaucggguggccggcgagagcgcugaacccgagccugagcccgaagccgacuauuacgcuaaggaggucacacgcgugcugaugguugaaacccacaaugagaucuaugauaaauucaagcaguccacacauucuauuuacauguuuuucaacaccagcgagcucagagaagccgugccggagccuguccugcugucccgggcggaacuccgccugcuuagacugaagcucaaaguggagcagcacguugaacuguaucagaaguacagcaauaacucuuggcgguaucuuuccaaucgccugcucgcccccagcgacucuccugaguggcuguccuuugaugugacaggggucgugagacaauggcugagccggggaggcgagaucgaaggcuuccgccucucugcucauuguuccugcgacagcagagauaacacccuucagguggacaucaauggguuuacgaccggacggagaggcgaucuggccacaauucacgggaugaaccgccccuuccugcuccugauggcuacaccccuugagcgggcccagcaucugcaguccucuagacaccgccgggcgcucgacaccaauuacuguuuuagcuccaccgagaaaaacugcugugucagacaacuguacaucgauuuccgcaaggaccugggauggaaauggauucacgaaccuaagggcuaucaugccaauuuuugccucgggccgugucccuacaucuggagccuggauacgcaguauucuaagguucuugcucuguacaaccagcacaauccuggagccuccgcugcccccugcugugugccucaggcccucgaaccccugccgauuguguauuacgucggccggaaaccuaagguggagcaacugagcaacaugaucguuagaucuugcaaauguagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6772 - RNA, 1521 nt, Artificial Sequence
  mRNA product Design5 comprising derived and/or modified sequence from Homo sapiens__NP_003229.1__HsTGFB2 (opt5)
gggagagucccgcagucggcguccagcggcucugcuuguucgugugugugucguugcaggccuuauucaagcuuaccaugcacuacugcgugcugagcgccuuccucauccugcaucuugucaccguugcucugucccucucuacauguagcacgcuggacauggaucaguuuaugagaaagcggauugaggccauccgcggccaaauucuuuccaaacugaagcucaccucucccccugaagacuauccggagcccgaagaggugccucccgaagugaucagcauuuacaacuccacaagagaucugcugcaggagaaagcgucucggcgcgcugccgccugcgagagagaacggagcgacgaggaauauuacgcuaaggaggucuauaaaaucgauaugccucccuucuuuccuuccgagaaugccaucccgcccaccuucuaccgcccuuauuuuagaauugugcgguucgacguuagcgcuauggaaaagaacgccucuaaucucgugaaggcggaguuucgcgucuucagacugcagaaccccaaagcccgggugccugaacagcgcaucgagcuuuaccaaauucugaaguccaaagaucucacaagccccacccagagauacaucgacucuaagguugugaaaacacgggcugaaggggaguggcuguccuuugaugucaccgacgccgugcacgaguggcuucaucacaaggaucgcaaucugggauucaagauuagccuccauuguccgugcuguacguuugugccuucuaacaauuauaucauucccaacaaauccgaggaacuggaagcuagauucgccggcaucgacgggaccagcacauacaccuccggagaucagaagacaaucaaaucuacccggaagaaaaauagcggcaagacgccucaucugcuccugaugcuucugcccuccuauagacucgagagccagcaaacaaaccgccggaaaaagagagcgcuggacgccgcuuacugcuuucgcaauguccaggacaacuguugccuucggccccuguauauugauuucaagagagaccucggguggaaauggauccacgaaccuaagggauacaaugccaacuucugugcuggcgccugcccguaucuguggucuuccgauacccagcacagccgcguucugucucucuacaauacaauuaaccccgaggccagcgcuuccccuuguugcgugucucaggaccuggagccccuuaccauccuguacuauauuggcaaaaccccuaagaucgaacaacucagcaacaugaucgugaaauccugcaaguguagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6773 - RNA, 1515 nt, Artificial Sequence
  mRNA product Design5 comprising derived and/or modified sequence from Homo sapiens__NP_003230.1__HsTGFB3 (opt5)
gggagagucccgcagucggcguccagcggcucugcuuguucgugugugugucguugcaggccuuauucaagcuuaccaugaagaugcaccuucagagagcccucgugguccuggcucugcugaacuucgccaccguuagccucucccugucuacaugcacgacccuugacuuuggccauaucaaaaagaaacggguggaggcgauucgcgggcaaauccugagcaagcucagacugacaucucccccugaaccgaccgugaugacacacguccccuaccaggugcuggcucucuauaauuccacccgggagcugcuugaagagaugcauggagaacgcgaggagggcuguacacaggaaaacaccgagagcgaauacuaugccaaagagauucacaaguucgauaugauccaggggcuggccgagcauaaugaacucgcuguuugcccuaagggaauuacguccaaaguguuuagauucaacgucucuagcguggagaagaaucggaccaaccuguuucgcgccgaguucagaguucuucgggugcccaauccuuccagcaaacgcaacgaacaaagaaucgaacuguuucagauccuccggcccgacgagcacauugcuaagcagcgcuacaucggcgggaaaaaucugccuacaagaggaaccgccgaguggcugucuuucgaugucacagacaccgugcgggaauggcuccugcgcagagaguccaaccuuggccuggaaauuagcauccacuguccgugccauacguuucagcccaauggcgauauucucgagaacauccacgaagugauggagauuaaguucaagggggucgacaaugaggaugaccauggacggggcgaucuggggagacuuaaaaagcaaaaagaccaccacaacccucaucugauccucaugaugauucccccucaccgccuggauaaucccggacagggcgggcagcggaagaaaagagcgcuggacacaaacuauuguuuucgcaaccucgaagagaauugcuguguucggccgcuguacaucgauuucagacaggaccuuggauggaagugggugcaugaaccuaaaggcuauuacgccaacuuuugcucuggccccuguccuuaccugcgcuccgcugacaccacacacagcaccgugcucgggcuguauaauacccuuaaccccgaggccucugcuucccccugcugugucccucaagaucuggaaccgcucacaauccuguacuaugugggacggacgcccaagguugagcagcugagcaauaugguggucaaguccugcaaaugcucuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6774 - RNA, 1662 nt, Artificial Sequence
  mRNA product Design5 comprising derived and/or modified sequence from Homo sapiens__NP_001057.1__HsTNFRSF1B (opt5)
gggagagucccgcagucggcguccagcggcucugcuuguucgugugugugucguugcaggccuuauucaagcuuaccauggcccccguggcugucugggccgcgcuggcuguuggccucgagcugugggccgccgcucacgcccuuccugcucagguggccuucaccccguacgcgcccgaaccugggagcacaugcagacugcgggaguauuacgaccaaacggcccagauguguugcuccaaguguucucccggacagcaugcuaaaguguuuugcaccaagacaagcgauaccgucugugacuccugcgaagauucuacauauacccagcucuggaacugggugccugagugucugagcugcggcucccgcuguucuagcgaccaaguugaaacacaggccugcaccagagagcagaaucggaucuguacgugccgccccgggugguacugcgcucuuuccaaacaggagggauguagacugugcgccccucuccggaagugucgcccgggcuucgggguggcgagacccggaaccgaaacaagcgaugucgugugcaaaccuugugcccccggcaccuuuucuaacacaaccuccagcacggacauuugccggccucaccaaaucuguaauguuguggcuauucccggcaacgccucuauggaugcugucugcacauccaccagcccgacacgcucuauggccccuggggccgugcaucugccccagccuguguccaccagaagccagcacacccagcccacacccgagccuuccacggcuccgucuaccagcuuccugcuccccaugggaccuuccccucccgcggaaggcagcacaggggacuuugcccugcccgucggacuuaucguuggcgugaccgcucuggggcuccugauuaucggaguggucaauugugugaucaugacacaaguuaagaagaaaccgcuuugccugcagcgggaggccaaggugccucaucuccccgccgauaaagcucgcggcacccagggcccugagcaacagcaucugcugauuacggcccccucuuccagcucuagcucccucgaaucuagcgcguccgcucuggacagacgggccccuacacgcaaccagccccaggccccgggggucgaggcuagcggagccggcgaagcuagagccucuaccggguccagcgauucuuccccuggaggccacgggacccaagugaauguuacauguaucgugaacgucugcagcuccucugaccacagcucccagugcucuagccaggcguccagcaccaugggagauacagacucuucccccagcgagucucccaaggacgaacaggugccuuucuccaaagaggagugugccuuucggagccaacuugaaacgccggagacccugcucggcucuacagaagagaagccccugccucuuggcguccccgaugcugggaugaagccuagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6775 - RNA, 789 nt, Artificial Sequence
  mRNA product Design5 comprising derived and/or modified sequence from Homo sapiens__NP_002623.2__HsPGF (opt5)
gggagagucccgcagucggcguccagcggcucugcuuguucgugugugugucguugcaggccuuauucaagcuuaccaugcccgugaugagacuguucccuugcuuucuccagcugcuugccggccuggcucucccggccguucccccucaacagugggcgcugagcgcugggaacggauccucugaggucgaaguggugcccuuccaggaggucuggggccggagcuacugucgcgcccuugaaagacugguggacguuguguccgaguauccuucugaagucgagcacauguuuagccccuccugcgugucucuccugcgguguaccgggugcuguggagaugagaaucugcauugcguuccuguggaaacagccaacgucacgaugcagcuccugaagauccgcagcggcgacagaccguccuacguggagcuuaccuucagccaacacgugcggugugaaugccgcccccugagagagaaaaugaagccugagcggcgcagacccaaagggcggggaaagcgcagacgggaaaaacagcgcccuacagauugucaucucugcggcgacgcuguccccagacggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6776 - RNA, 1515 nt, Artificial Sequence
  mRNA product Design5 comprising derived and/or modified sequence from Homo sapiens__NP_001020537.2__HsVEGFA (opt5)
gggagagucccgcagucggcguccagcggcucugcuuguucgugugugugucguugcaggccuuauucaagcuuaccaugaccgacagacagacagauacggcccccagcccuuccuaccaccuucucccgggccggcgcagaaccguggacgcugccgcgucucgggggcaaggacccgagccugcucccggcgggggagucgaaggcguuggggcccgcggaguggcccugaagcuguucgugcagcugcucggcugcagcagauuuggcggggcugucgugcgggccggagaggcugaaccuuccggcgccgcgcgcucugccagcuccgggagagaggaaccccagccugaggagggagaagaggaagaggagaaagaagaggaacggggcccgcaguggcgccugggggcuagaaagcccggaucuuggacaggcgaggccgcuguuugugccgauagcgcgccugccgcucgggcuccccaagcccuugcccgcgccuccggcagagggggacggguggcucgcagaggcgcggaagagagcgggccuccccauucuccgucccggagaggaagcgccucucgcgcuggcccugggcgggccuccgagaccaugaacuuccugcucagcuggguccacuggucucuggcccugcuccuguaucuucaucacgcuaaauggucccaggccgcgcccauggcugaaggaggcggccagaaucaucacgaggugguuaaguuuauggacguguaccagagaagcuauugccacccuaucgaaacacuggucgauauuuuccaagaguaccccgacgaaaucgaguauauuuuuaaacccuccugugugccucucaugcgcugcgggggauguugcaacgaugagggccuggaaugugugccgaccgaggaaucuaauaucacaaugcagauuaugcggaucaagccccaucaggggcagcacaucggagagaugagcuuccuucaacauaacaagugcgaauguagaccuaaaaaggaccgcgcccggcaggagaaaaaguccgucagaggcaaagggaagggccagaagcgcaaacggaagaaaagcagauacaagucuugguccguuuaugugggagcccgcugcugucugaugcccuggagccucccuggcccccacccgugcgggccuugcucugagcggagaaaacaccuguuugugcaagauccccagaccuguaagugcagcuguaaaaauacggacucccggugcaaggcucgccagcuggaacucaacgagagaaccugucggugcgauaagccuagacgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6777 - RNA, 975 nt, Artificial Sequence
  mRNA product Design5 comprising derived and/or modified sequence from Homo sapiens__NP_001165094.1__HsVEGFA (opt5)
gggagagucccgcagucggcguccagcggcucugcuuguucgugugugugucguugcaggccuuauucaagcuuaccaugaacuuccugcucagcugggugcacuggucccuggcccuucugcucuaccugcaucacgcuaaguggucucaggccgcgcccauggcugagggcgggggacaaaaucaucacgaagucguuaaauuuauggacguguaucagagaagcuacugccauccuaucgagacccuuguggauauuuuccaggaauauccggacgagaucgaauacauuuuuaagcccuccugugucccucugaugcggugcggcggguguugcaacgaugagggacucgagugugugcccacagaagagucuaauaucacgaugcagauuaugcgcaucaaaccucaccaaggccagcacaucggggaaaugagcuuccugcagcauaacaagugcgaguguagacccaaaaaggaccgggcccgccaggagaagaaauccguuagaggaaagggcaaaggccaaaagcggaaacgcaagaagucuagauauaaaagcugguccguguacgucggggcccggugcugucugaugccuuggagccucccgggaccccacccuugcggccccuguucugaacgcagaaagcaucuguuugugcaggauccucagaccugcaaaugcuccuguaagaauacagacagccggugcaaagcucgccagcuugagcugaacgaaagaaccugucggugcgauaagccccgcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6778 - RNA, 900 nt, Artificial Sequence
  mRNA product Design5 comprising derived and/or modified sequence from Homo sapiens__NP_003368.1__HsVEGFB (opt5)
gggagagucccgcagucggcguccagcggcucugcuuguucgugugugugucguugcaggccuuauucaagcuuaccaugagcccccugcucagacggcugcuucuggccgcucuccugcagcuugccccugcgcaagcuccggugucccagcccgacgccccuggccaccagcgcaaggucguuucuuggaucgauguguacaccagagccacaugccagccccgggagguggucgugccucugacgguugaacucauggggaccguggcuaagcaacugguccccagcugugugacaguucagcgcugcggaggcuguugcccugacgaugggcuggagugugugccgaccggacagcaucaggucagaaugcaaauucucaugauccgguaucccuccucucagcugggcgaaaugagccuugaggaacacucccagugcgagugucgcccuaagaaaaaggacucugccgugaaacccgauagagcugccacaccucaucaccggccccagccgcgcagcgugccugggugggacuccgcgcccggagccccuagccccgcugauauuacccaucccaccccugccccgggccccucugcucacgccgcgccuuccacaacgagcgcccugacccccggcccugcugccgcugccgccgacgcugcggccucuuccgucgcuaaagggggagccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6779 - RNA, 1536 nt, Artificial Sequence
  mRNA product Design5 comprising derived and/or modified sequence from Homo sapiens__NP_005420.1__HsVEGFC (opt5)
gggagagucccgcagucggcguccagcggcucugcuuguucgugugugugucguugcaggccuuauucaagcuuaccaugcaucugcucggcuucuuuagcguggccugcucccugcuugcugccgcgcugcuccccgggccuagagaggcuccggccgccgcugccgcuuucgaaucuggacuggaccuuagcgaugccgagcccgacgcgggcgaagccaccgcuuacgccuccaaggaucuggaggaacagcuccggucugucagcuccguugacgagcugaugacagugcuguauccugaguacuggaaaauguauaagugucaacuccgcaaagggggauggcagcacaacagagaacaggcuaaucugaacucucggacggaggaaaccaucaaguuugccgcggcccacuacaauacagagauucuuaaaagcaucgauaacgaguggcgcaagacccagugcaugcccagagaaguguguauugacgucggcaaggaguucgggguggcuacaaauaccuuuuucaaaccucccugcguuuccguguaucgguguggaggcugcuguaacagcgaaggccugcaaugcaugaauacaucuaccuccuaccucagcaagacgcuguuugagaucaccgucccucuuucucaggggccgaaacccgugacaauuuccuucgccaaccauaccagcugucgcugcaugucuaagcuggauguuuauagacaggugcacuccaucauccggcgcagccucccugcuacacugccccagugucaagccgccaauaaaaccugcccuacgaacuacauguggaauaaccauauuugcagaugucuggcucaggaagacuuuauguucuccucugaugcgggagacgauagcacagacggcuuucacgauaucugcgggcccaauaaggagcucgacgaggaaaccugucagugcgucugucgggccggacugcgcccggcuuccugcggcccucacaaggagcuugacagaaacagcugucagugcguguguaaaaauaagcuguuccccucucaaugcggggccaaccgggaauuugaugagaacacaugucagugcgugugcaaacgcaccuguccuagaaaucagccccucaaccccggaaagugcgccugugaaugcaccgaguccccucaaaaaugucugcuuaagggcaaaaaguuccaucaccagacaugcagcuguuaccggagaccgugcacgaaucgccagaaggcuugugagcccggcuucucuuauagcgaagaggucugccgguguguuccuuccuacuggaaaagaccccagaugucuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6780 - RNA, 1341 nt, Artificial Sequence
  mRNA product Design5 comprising derived and/or modified sequence from Homo sapiens__NP_004460.1__HsVEGFD (opt5)
gggagagucccgcagucggcguccagcggcucugcuuguucgugugugugucguugcaggccuuauucaagcuuaccauguacagagaguggguggucguuaacguguucaugaugcuguaugugcagcucguccaaggcagcuccaaugaacacgggcccgugaagcggucuagccaguccacccuggagcgcucugaacagcagaucagagccgcuagcucccuugaggaacugcuccggauuacacauucugaggacuggaaacuguggcgcugcagacuucggcucaagagcuuuacguccauggauagccgcucugccucccacagaagcacccgguucgcggcuacauuuuacgacaucgagacccugaaaguuauugaugaagaguggcaacgcacacaguguucuccuagagaaaccugcguggaggucgccuccgagcugggaaagagcacaaacaccuucuuuaaaccgcccugugugaauguuuuccggugcggcggguguugcaacgaagagucucugaucuguaugaauacguccaccagcuauauuuccaagcagcucuuugaaaucucugugccucugacaagcguccccgagcuugugccugugaaggucgccaaccauaccggaugcaaaugucugcccacagcuccucgccacccguacuccaucauuagacggagcauccagauucccgaagaggaccgcugcucucauuccaagaaacucuguccuaucgauaugcugugggacagcaauaagugcaaaugcguucuucaagaggaaaacccccuggccggcaccgaggaucacucucaccuccaggaaccugcucugugugggccccauaugauguucgacgaggauagaugcgaaugugugugcaagacgccguguccuaaggaccugauucagcaccccaaaaauugcagcuguuuugagugcaaggagucccucgaaacauguugccagaaacauaagcuguuccacccugauaccuguucuugcgaggaccggugccccuuucacacaagacccugugccagcggaaaaaccgcgugcgccaagcauugucgcuucccuaaagaaaagcgggcugcccaaggcccgcacuccagaaagaaccccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6781 - RNA, 906 nt, Artificial Sequence
  mRNA product Design5 comprising derived and/or modified sequence from Homo sapiens__NP_061986.1__HsFGF21 (opt6)
gggagagucccgcagucggcguccagcggcucugcuuguucgugugugugucguugcaggccuuauucaagcuuaccauggacucagacgaaacaggauuugaacacucaggauuauggguaucaguauuagcaggauuacuacucggagcaugccaagcacacccaaucccagacucaucaccauuauuacaauucggaggacaagucagacaacgauacuuauacacagacgacgcacaacaaacagaagcacauuuagaaauaagagaagacggaacaguaggcggagcagcagaucaaucaccagaaucacuacuacaacuaaaagcacuaaaaccaggaguaauacaaauauuaggaguaaaaacaucaagauucuuaugccaaagaccagacggagcacuauacggaucauuacacuuugauccagaagcaugcucuuucagagaacuacuacuagaagacggauacaacguauaccaaucagaagcucauggacuaccuuuacaccuaccaggaaacaaaucaccacacagagauccagcucccagaggacccgcaagauuccuaccauuaccaggauuaccaccagcauuaccagaaccaccaggaauacuagcaccacaaccaccagacguaggaucaucagacccauuaucaaugguaggaccaucacaaggaagaucaccaucauacgcaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6782 - RNA, 1686 nt, Artificial Sequence
  mRNA product Design5 comprising derived and/or modified sequence from Homo sapiens__NP_002412.1__HsMMP1 (opt6)
gggagagucccgcagucggcguccagcggcucugcuuguucgugugugugucguugcaggccuuauucaagcuuaccaugcacucauuuccaccacuauuauuacuacuauuuuggggagucguaucacauagcuuucccgcaacacuagaaacccaagaacaagacguagacuuaguacaaaaauaucuagaaaaauacuauaaccucaaaaacgacggaagacaagucgaaaaaagaagaaacagcggaccaguuguagaaaaacuaaaacaaaugcaagaauuuuucggauuaaaaguuacuggaaaaccagacgcagaaacacuaaaaguaaugaaacaaccaagaugcggaguaccagauguagcacaguucguauuaacagaaggaaacccacguugggaacaaacacaucuuacauacagaauugaaaauuacacaccugaccuaccaagagcagacguagaccacgcaauagaaaaagccuuucaauuauggucaaacguaacaccauuaacauucacaaaaguuucugaagggcaagcagacauaaugaucucauuuguuagaggagaccaccgagacaauagcccauucgacgggccaggaggaaaccuagcacaugcuuuccaaccaggaccuggaauaggaggcgacgcacauuucgacgaagacgaacgauggacaaacaauuucagagaauacaaccuacauagaguagcagcccacgaauuaggccacagccuaggcuuaucacacucaacagacauuggagcucuaauguacccuuccuacacauuuucaggagacguacaauuagcccaagacgauauagacggaauacaagcaauauacggacgaucacaaaacccaguacaaccaauaggaccacaaacaccaaaagcaugcgacucaaaauuaacauuugacgccauaacaacaauaagaggagaaguaauguuuuucaaagaccgauuuuauaugagaacaaauccauucuacccagaaguagaauuaaacuuuauaaguguauucuggccucaauuaccaaacggauuagaagcagcauaugaauuugcagacagagacgaaguacgauucuuuaaaggaaauaaauacugggccguacaaggacaaaacguauuacauggauacccaaaagacauauacagcucauucggguuuccaagaacaguaaaacacauagacgccgcauuaucagaagaaaacacaggcaaaacauauuuuuucguagcaaacaaauacuggagauacgacgaauacaaaagaucaauggacccaggauauccaaaaaugauagcacacgauuucccuggcauugggcacaaaguagaugcaguauucaugaaagauggcuuuuucuacuucuuucacggaacucgacaauacaaauucgacccaaaaacaaaaagaauacucacacuacaaaaagcaaacaguugguucaauuguagaaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6783 - RNA, 1446 nt, Artificial Sequence
  mRNA product Design5 comprising derived and/or modified sequence from Homo sapiens__NP_002412.1__HsMMP1(1-19,100-469) (opt6)
gggagagucccgcagucggcguccagcggcucugcuuguucgugugugugucguugcaggccuuauucaagcuuaccaugcauucauucccaccacuacuauuauuauuauucuggggaguaguaucacauucauuuguacuaacugaaggaaauccuagaugggaacaaacucacuuaaccuauagaauagaaaacuauacaccagaccuaccaagagccgacgucgaccacgcaauugaaaaagcauuccaauuauggaguaacguaacaccacuaacauucacaaaaguaucagaaggacaagcagacauaaugauaucauuugucagaggagaccaccgagacaacucaccauuugacggaccuggaggaaaucucgcacacgcauuccaaccaggaccaggaauaggaggagacgcacauuuugaugaagaugaacgauggaccaacaauuuuagagaauacaaccuacaccgaguagccgcacacgaacucggacacagccuaggacuaucacacucaaccgacaucggagcacuaauguacccaucauacacauucuccggagacguccaacuagcucaagacgacauagacggaauacaagcaauauacggaagaucacaaaauccuguacaaccaauaggaccacaaaccccaaaagcaugcgacucaaaauuaacauuugacgcaauaaccacaauuagaggugaaguaauguuuuucaaagauagauuuuacaugagaacaaaucccuucuauccagaaguagaauuaaauuucauaucaguauucuggccacaacuaccaaauggauuagaagcagcauacgaauuugcagauagagacgaaguaagauucuucaaaggcaacaaauacugggcaguacaaggccaaaacguacuacacggauauccuaaagacauauacucuuccuuuggauuuccuagaacaguaaaacacauagaugccgcacuaucagaagaaaacaccggaaaaacauacuucuucgucgccaauaaauacuggagauacgacgaauauaaacgaucaauggacccagguuacccaaaaaugauagcacacgauuucccaggaauaggacacaaaguugacgcagucuuuaugaaagacggauuuuucuacuucuuucacggaacacgacaauacaaauucgaucccaaaacuaaaagaauccuaacuuuacaaaaagccaauucuugguuuaauuguagaaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6784 - RNA, 3633 nt, Artificial Sequence
  mRNA product Design5 comprising derived and/or modified sequence from Clostridium histolyticum__BAA77453.1__ColG (opt6)
gggagagucccgcagucggcguccagcggcucugcuuguucgugugugugucguugcaggccuuauucaagcuuaccaugaaaaaaaacauacucaaaauucuaauggacucauacucgaaagaaucaaaaauacaaacaguccgcagaguuacaucagucucguuacuagcaguauaccugacgaugaacacauccucguuaguacucgcuaaaccuauagaaaauaccaacgauaccaguauaaaaaacguagaaaaauuaagaaaugcaccaaacgaagaaaacaguaaaaaaguagaagacaguaaaaaugacaaaguagaacauguaaaaaacauagaagaagcaaaaguugaacaaguagcaccagagguaaaauccaaaagcacauuaagaagcgcgucaaucgccaacacaaauucagagaaguacgacuucgaauacuuaaacggauuaaguuauacagaacuaacaaaucucauuaaaaauaucaaauggaaccagauaaauggacuauuuaauuacucaacaggaucacaaaaauuuuucggagacaaaaauagaguacaagcaauuauaaacgcuuuacaagaaagcggacgaacguauacagcaaacgauaugaaaggaauugaaacauucacagaaguacuacgcgcugguuuuuaucugggcuauuauaacgacggacuaucauaccucaacgaccgaaacuuccaagauaaaugcauaccagcgaugauugcaauucaaaaaaacccaaacuuuaaacuaggaaccgcaguccaagaugaaguaauaacgucgcucggaaaacuaauaggaaaugcaagcgcuaaugcagaaguuguaaauaacuguguucccguacuaaaacaauuccgagaaaauuuaaaucaauacgcaccagauuacgucaaaggaacggccguuaaugaacuuaucaaaggaauagaauuugauuucucaggagcagcuuaugaaaaagacguaaagacuaugccaugguacggaaaaauagaucccuuuauaaaugagcugaaggcacuaggccuuuacggaaacaucacaucagcuacagaaugggcgucagaugucgggauauacuaucuaucaaaauucggacuuuacucaaccaaccgaaaugauauaguacaauccuuagaaaaagcaguagauauguauaaauacggaaaaauagcuuucgucgcaauggaacgaaucacaugggauuaugacgguauaggaagcaauggaaaaaaaguagaucaugacaaauuccuagaugacgcagaaaaacauuaccuccccaaaacauacaccuucgauaacggcacauucauaauaagagcuggagacaaaguaucagaagaaaaaaucaaacguuuauacugggcaucacgagagguuaaaucacaauuccauagaguagucgguaaugacaaagcauuagaaguaggcaaugcagacgacguacucacaaugaaaauauucaauucuccugaagaauauaaauuuaauaccaacauuaacggaguaucuacagacaauggaggccuuuacauagaaccaagaggaacguucuauaccuacgaaagaacaccacaacaaucaaucuuuucauuagaagaacuauuuagacacgaauacacacacuaucugcaagcacgauaccugguggauggacuauggggacaagggccauuuuaugaaaaaaaccgcuuaacaugguuugaugaaggcacagccgaauuuuucgcaggaucaaccagaacaucgggugucuuaccacggaaaucaauacucggguacuuagcaaaagacaaaguagaucauagauauucauuaaaaaaaacacuaaauaguggauaugaugacucggauuggauguuuuacaacuaugguuuugcgguagcacauuauuuauaugaaaaagauaugcccacauucauaaaaaugaacaaagcuauauuaaauaccgauguaaagagcuaugaugaaauaauaaaaaaacucagugaugaugcaaauaaaaacacugaauaucaaaaccacauacaagaacuagcagacaaauaccaaggagcagguauuccguuaguuucagaugauuacuuaaaagaccacggauauaaaaaagcaucagaaguauacagugaaauaucgaaagcagccagccuuacaaacaccucaguaacagcagagaaaagucaauauuucaacacauuuacacuaagaggaacauacacgggggaaaccucaaaaggagaauuuaaagauugggaugaaauguccaaaaaacuagacggaacacuagagagcuuagcuaaaaacaguuggagcggauacaaaacuuuaacggcauacuuuacuaacuaccgaguuacaagugacaauaagguucaauacgacguaguauuucacggaguacuaacagacaacgcugauauuaguaacaacaaagcgccuaucgcuaaaguaacaggaccaucgacuggggcagucggaaggaacauagaauuuucugggaaagacaguaaagaugaagacggaaaaauaguuaguuacgauugggauuuuggcgauggagcuaccucucguggaaagaacucugugcaugcauacaaaaaagcaggaacauauaacguaacccuaaaaguaacagacgacaaaggagcaacagcuacagagagcuuuaccauagaaauaaaaaacgaagauacaacgacaccaauaacaaaagagauggaaccuaaugaugacauaaaagaagcuaacggacccauaguggaaggaguaacagugaaaggagaccugaauggcagcgaugacgcugauacuuuuuauuucgaugucaaagaagacggugacguaaccauugaacuaccguacagcggcaguucaaauuuuacaugguugguauauaaagaaggagacgaccaaaaccacauagcaucuggaauagauaaaaauaacucaaaaguugguacauuuaaaaguacaaaagguagacacuauguauucaucuauaaacacgacagcgcaucaaacauauccuauucccucaauauaaagggacuaggaaaugaaaaacugaaagaaaaagaaaauaacgauuccagugacaaagcaacuguaaucccaaauuuuaauacaacaaugcaaggaucuuuauuaggagacgauagucgcgacuauuacucauuugaagugaaagaagaaggagaaguaaauauagaacuugacaaaaaagacgaguucggaguaaccuggacucuccacccagaaucaaauauaaacgauagaaucacauacggacaaguagacgguaacaaagucucaaauaagguaaaacuuagaccagggaaauacuauuuacucguauauaaauacucuggcagcggcaacuacgaguuacggguuaacaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6785 - RNA, 3357 nt, Artificial Sequence
  mRNA product Design5 comprising derived and/or modified sequence from Clostridium histolyticum__BAA77453.1__HsALB(1-18)_ColG(111-1118) (opt6)
gggagagucccgcagucggcguccagcggcucugcuuguucgugugugugucguugcaggccuuauucaagcuuaccaugaaaugggucaccuuuauaagucuacuuuucuuauuuuccucagcauauagcauagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6786 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt6)
gggagagucccgcagucggcguccagcggcucugcuuguucgugugugugucguugcaggccuuauucaagcuuaccaugaaguggguaacuuucauaagucuucuuuuccuuuucucuucagcauacucgaugaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6787 - RNA, 3381 nt, Artificial Sequence
  mRNA product Design5 comprising derived and/or modified sequence from Clostridium histolyticum__BAA34542.1__ColH (opt6)
gggagagucccgcagucggcguccagcggcucugcuuguucgugugugugucguugcaggccuuauucaagcuuaccaugaacuuucucaaaauaauacugaaccguggcaaaacaaugaaaagaaaaugccuaaguaaaagacucaugcuggccaucacaauggcuacaauauucaccgucaacagcaccuuaccuauuuaugcagccguagacaaaaauaacgcuacugccgccguacaaaaugaaagcaaaagauacacugucucguaucuuaaaacacuaaauuacuacgaccuaguagauuuauuaguaaaaacagaaauagaaaaccuaccugaucucuuucaauacucaucagaugccaaagaauuuuacggaaacaaaacacgaaugucuuuuauaauggaugaaauaggccgcagagcuccacaauacaccgaaaucgaccacaaaggaauaccaacauuaguggaagugguaagagcaggauuuuauuuaggcuuccacaacaaagaacuaaacgaaauaaauaaaagauccuucaaggaaaggguaauacccucaauauuagcaauacagaaaaaccccaauuucaaacuaggaacagaagugcaagacaaaaucgucagcgcaacgggacuucuagccgguaacgaaacugcuccaccagaaguaguaaacaacuucaccccaauccuacaagacuguauuaaaaacauagacagauaugcauuagacgaucuaaagucaaaggcuuuauuuaacgucuuagcugcaccuacuuacgacauaacagaauaccucagggcaacaaaagaaaaaccggaaaauacaccuugguacggaaaaauagauggcuucauaaacgaacuaaagaaauuagccuuauacggaaaaauuaacgauaauaacucuuggauaauagauaaugguauuuaccacauagcuccguuagggaaacugcauaguaacaauaaaaucggaauagaaacauuaaccgaagucaugaaaguauacccauauuuaucaaugcaacacuuacaauccgccgaccaaaucaaaagacacuacgacagcaaagaugcagaaggaaauaaaauaccauuagauaaauucaagaaagaaggaaaagaaaaauacugcccaaaaaccuauacuuucgacgauggaaaaguaauaauaaaagcuggagcaagagucgaagaagaaaaaguaaaacgacucuacugggcaucaaaagaagucaacucacaauucuucagagucuauggcauagauaaaccgcuagaagagggaaaccccgaugacauccuaacaaugguaauauacaauucaccagaagaguauaaacuaaauagcguauuauacggauacgacacaaauaacggcggaauguacaucgaaccugaaggaaccuucuucaccuaugagcgagaagcccaagaaaguacauacacccuggaagaacuauucagacaugaauacacacauuaccuacaaggacgauacgccgugccaggacaaugggggcgaacgaaauuauacgacaacgacagacucacaugguaugaagaagguggagcagaauuauucgcaggcaguacccguacaucagguauccuaccaagaaaaucuaucgucaguaacauacacaacacaacuaggaauaaucgauacaaauuaucagacacaguacauuccaaauacggggccuccuucgaauuuuacaacuacgcgugcauguuuauggauuauauguauaacaaagauauggguauucuaaacaaauuaaacgaccuagccaagaauaaugacguggacggauacgacaacuauauuagggaccuaucaucaaauuaugcauuaaacgacaaauaccaagaccacaugcaagagaggauagauaauuacgaaaaccuaacaguaccauuugucgcagacgauuauuuagugcgacaugcauacaaaaauccaaacgaaaucuacagugagauuucagagguagcaaaacucaaggaugcgaaauccgaagucaagaaaagucaauacuucaguacauucacgcuaagaggaucauauacaggaggagccucaaaaggaaaauuagaagaccaaaaagcaaugaauaaauucauagacgauucauuaaagaaacuagauaccuacaguuggaguggcuauaaaacacucacugcauauuucacaaauuacaaaguagacucaucuaauaggguaaccuacgauguaguauuccacggauaccucccaaaugaaggcgacagcaaaaacucucucccauacggaaaaauaaacgggacauacaaagguacugaaaaagagaaaaucaaauucagcagcgaaggauccuucgacccagacggaaaaauuguuaguuaugaaugggacuucggagauggaaacaaaaguaaugaagaaaacccagaacauuccuaugacaaagucgggacuuacaccguaaaauuaaaaguuacagaugauaaaggcgaauccaguguaucaacaacaacagccgaaaucaaagacuuaagcgaaaauaaacuuccaguaauauauaugcacguaccaaaaucuggagcacuuaaccaaaaaguaguauucuacgguaaagguacauacgauccagacggaucaauagcuggguaucaaugggacuuuggagacgguucagauuucucaucagaacaaaaucccucccacguauacacaaagaaaggugaauacacagugacacuaagagucauggauagcagcggccaaaugucagagaaaacaaugaaaaucaaaauaacugaucccguauauccaauaggcacagaaaaagaaccaaacaacagcaaagaaacagccagcggaccaauaguaccaggcauacccgucaguggaacuauagaaaauacauccgaccaagacuacuuuuacuucgauguaauaaccccuggagaaguaaaaauagacauaaacaaauuagguuaugggggcgcaacauggguaguguacgaugaaaauaauaacgcaguaaguuaugcuacagacgacggccaaaaucuauccggaaaauucaaagcagacaaaccaggcagauacuauauucaucuauauauguuuaacgguagcuacaugccuuacaggaucaacauagaaggaagcguagguagauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6788 - RNA, 3342 nt, Artificial Sequence
  mRNA product Design5 comprising derived and/or modified sequence from Clostridium histolyticum__BAA34542.1__ColH (opt6)
gggagagucccgcagucggcguccagcggcucugcuuguucgugugugugucguugcaggccuuauucaagcuuaccaugaaacguaaaugccuuucaaaacgucuaauguuggcaauuacuauggcaacaauauuuacaguuaauuccacacuaccaauauaugcagcuguagacaaaaacaaugccacagccgcaguacaaaaugaauccaaaagguacacugucaguuaucuaaaaacucuuaacuauuacgaccuaguugaccuauuaguaaaaacagaaauagaaaaccuaccagacuuauuccaauacucaucugaugcuaaagaauuuuacggaaauaaaacccgcaugaguuuuaucauggaugaaauaggaagacgagcgccucaauauacugaaaucgaucacaaaggaauaccgacgcuaguagaaguuguaagagccgguuuuuacuuaggcuuucacaacaaagaacuaaacgaaauaaauaaacgaucauuuaaagagagaguaauacccagcauccuugccauacaaaagaauccaaacuucaaauuaggaacagagguacaagacaaaauaguauccgccacaggccuauuagcaggaaaugagacagcacccccugagguagugaacaauuucacaccaauauuacaagauugcauuaaaaauauagauagauaugcucuagaugaucuaaaaucaaaagcacuauucaacguacuagcagcacccacauacgauauaacagaauacuuacgagcgaccaaagaaaaaccagaaaacacaccaugguacggaaaaauagacggcuuuauaaaugaguuaaagaaauuagcauuauaugguaaaauaaaugauaauaacagcuggauuauagacaacgggauauaucauauagcaccccuaggaaaacuacacucaaacaauaaaauaggaauagaaacauuaaccgaagucaugaaaguuuauccuuacuuauccaugcaacacuuacaaucagcagaucaaauaaaaagacauuaugauucaaaagacgcagaagguaacaaaauaccccuagacaaauuuaagaaagaaggaaaagaaaaauauugcccaaaaacauacacauuugacgacgggaaaguaaucauaaaagcaggagcgagagucgaagaagaaaaaguaaaaagacucuacugggcaucuaaagaaguaaacucccaauucuucaggguauauggaauagacaaaccauuagaagaaggaaaucccgaugacauuuugacaaugguaaucuauaauaguccggaagaauauaaacugaacagugucuuauacggauaugauaccaacaacgguggaauguauauagaaccagagggaaccuucuucaccuaugaaagggaagcccaagaaucaacauacacucucgaggaacuauuuaggcacgaauauacacacuauuuacaaggacgauacgcaguaccaggacaauggggcaggacaaaacuuuacgauaacgacagacuaacuugguaugaagaagguggcgccgaacuauucgccgguucaacucgcacaagcggaauauugccacgaaaaucaaucguaucuaacauacacaacacaacaagaaauaaccguuacaaacuaucagauacaguucacuccaaauacggagcaaguuuugaauuuuacaacuacgccuguauguuuauggacuacauguauaauaaagauaugggcauacuaaauaaacugaacgauuuagcuaaaaacaaugacguagacggcuacgacaacuacauaagagauuuaaguuccaacuaugcacuaaaugauaaauaucaagaucacaugcaagaaagaauagauaacuaugaaaauuuaacaguaccuuuuguggcagacgauuaccuuguucgacacgcauauaaaaaccccaaugagauauauucagaaauuucagaaguagcaaaauuaaaagaugcaaaaagcgaaguaaagaaaagccaauacuucuccacauuuacccuccgaggaucauacaccggcggagccuccaaaggaaaacuagaagaccaaaaagcuaugaacaaauucauagaugacucccuaaagaaauuagacacauauucaugguccggauacaaaacccuaacggcuuacuucacaaauuacaaagucgacuccucaaauaggguuacauacgacgucguauuucacggauaucuccccaaugagggagacaguaaaaauucccuaccauacgggaaaauaaacggaacauauaaagggacagaaaaagagaaaauaaaauucucgucugaaggaucuuuugaccccgacgggaaaauugugucauaugaaugggauuuuggagauggaaauaaaucaaaugaagaaaacccagaacacagcuaugacaaaguaggcacauacaccguaaaauuaaaaguaacagacgacaaaggagaaucaucaguauccaccaccacagcagaaauuaaagaucuaucugaaaacaaacucccaguaaucuauaugcacguaccuaaaaguggcgcucucaaucaaaaaguaguauuuuacggaaaaggaacauaugacccagacggaagcauagcaggguaucaaugggauuucggagauggaucugauuuuucuucagaacaaaacccaucgcacguauacaccaagaaaggagaauauacaguaacacuaagaguuauggauucaucuggacaaaugucugagaaaacuaugaaaauaaaaauaacagacccaguuuauccaauaggcacagaaaaagaaccaaacaacaguaaagaaacagcaucaggaccaaucgucccgggcauaccaguaaguggaacaauagaaaauacaagcgaccaagauuacuucuacuucgauguaauaacaccaggcgaaguuaaaauugacauaaacaaacucggauauggaggagcaacauggguaguauaugaugaaaacaauaaugccguaucuuacgccacagacgauggacaaaaccuaaguggaaaauuuaaagcugauaaacccggacgcuacuacauacaccuguauauguuuaacgguucauacaugccauacaggauaaacauagaagggagugugggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6789 - RNA, 3276 nt, Artificial Sequence
  mRNA product Design5 comprising derived and/or modified sequence from Clostridium histolyticum__BAA34542.1__HsALB(1-18)_ColH(41-1021) (opt6)
gggagagucccgcagucggcguccagcggcucugcuuguucgugugugugucguugcaggccuuauucaagcuuaccaugaaauggguuacuuuuauaucauuacuauuccuauucucaucagcauacagcguacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6790 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt6)
gggagagucccgcagucggcguccagcggcucugcuuguucgugugugugucguugcaggccuuauucaagcuuaccaugaaauggguuacauucaucagcuuacuauuccuauucaguagcgccuacagcaugaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6791 - RNA, 852 nt, Artificial Sequence
  mRNA product Design5 comprising derived and/or modified sequence from Homo sapiens__NP_001133.1__HsAMELX (opt6)
gggagagucccgcagucggcguccagcggcucugcuuguucgugugugugucguugcaggccuuauucaagcuuaccauggguaccuggauauuauucgcaugccuacuaggcgcagcauucgccaugccauuaccaccacacccaggacacccaggauacaucaacuucucauacgaaguacuaacaccacuaaaaugguaccaaucaauaagaccaccauacccaucauacggauacgaaccaauggguggauggcuacaccaccaaauaauaccaguacuaucacaacaacacccaccaacacacacacuacaaccacaccaucacauaccaguaguaccagcacaacaaccaguaauaccacaacaaccaaugaugccaguaccaggacaacacuccaugacaccaauacaacaucaccaaccaaaccuaccacccccagcacaacaaccauaccaaccacaaccaguacaaccacaaccacaccaaccaaugcaaccacaaccaccaguacaccccaugcaaccacucccaccacaaccaccacuaccaccaauguucccaaugcaacccuuaccaccaaugcuaccagaccuaacacuagaagcauggcccucaacagacaaaacaaaaagagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6792 - RNA, 411 nt, Artificial Sequence
  mRNA product Design5 comprising derived and/or modified sequence from Homo sapiens__NP_001133.1__HsAMELX-TRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaucaauaagaccaccauacccaucauacggauacgaaccaaugggaggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6793 - RNA, 444 nt, Artificial Sequence
  mRNA product Design5 comprising derived and/or modified sequence from Homo sapiens__NP_001133.1__HsAMELX-LRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6794 - RNA, 483 nt, Artificial Sequence
  mRNA product Design5 comprising derived and/or modified sequence from Homo sapiens__NP_001133.1__HLA-A2-SP_HsAMELX(17-60) (opt6)
gggagagucccgcagucggcguccagcggcucugcuuguucgugugugugucguugcaggccuuauucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccauacccaucauacggauacgaaccaaugggaggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6795 - RNA, 516 nt, Artificial Sequence
  mRNA product Design5 comprising derived and/or modified sequence from Homo sapiens__NP_001133.1__HLA-A2-SP_HsAMELX(17-47,168-191) (opt6)
gggagagucccgcagucggcguccagcggcucugcuuguucgugugugugucguugcaggccuuauucaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6796 - RNA, 855 nt, Artificial Sequence
  mRNA product Design5 comprising derived and/or modified sequence from Homo sapiens__NP_001134.1__HsAMELY (opt6)
gggagagucccgcagucggcguccagcggcucugcuuguucgugugugugucguugcaggccuuauucaagcuuaccaugggaacauggauacuauucgcaugcuuaguaggagcagcauucgccaugccacuaccaccacaccccggccacccaggauacauaaacuucucauacgaaguauuaacaccacuaaaaugguaccaaucaaugauacgcccaccauacuccucauacggauacgaaccaaugggcggcugguuacaccaucaaauaauaccaguaguaucccaacaacacccacuaacacacacacuacaaucacaccaccacauaccaguaguaccagcacaacaaccacgaguacgccaacaagcacuaaugccaguaccaggacaacaaucaaugacaccaacacaacaccaccaaccaaaccuaccauuaccagcacaacaaccauuccaaccacaaccaguacaaccccaaccacaccaaccaaugcaaccacaaccaccaguacaaccaaugcaaccacuccuaccccaaccaccacuaccaccaauguucccacuaagaccacuaccaccaauacuaccagaccuacaccuagaagcauggccagcaacagacaaaacaaaacaagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6797 - RNA, 414 nt, Artificial Sequence
  mRNA product Design5 comprising derived and/or modified sequence from Homo sapiens__NP_001134.1__HsAMELY-TRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaucaaugauaagaccaccauacucaucauacggauacgaaccaaugggaggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6798 - RNA, 447 nt, Artificial Sequence
  mRNA product Design5 comprising derived and/or modified sequence from Homo sapiens__NP_001134.1__HsAMELY-LRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguauuaacaccacuaaaaugguaccaaucaaugauaagaccaccaccaauacuaccagaccuacaccuagaagcauggccagcaacagacaaaacaaaacaagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6799 - RNA, 486 nt, Artificial Sequence
  mRNA product Design5 comprising derived and/or modified sequence from Homo sapiens__NP_001134.1__HLA-A2-SP_HsAMELY(17-61) (opt6)
gggagagucccgcagucggcguccagcggcucugcuuguucgugugugugucguugcaggccuuauucaagcuuaccauggcaguaauggcaccaagaacauuaguacuacuacuaucaggagcacuagcacuaacacaaacaugggcaaugccacuaccaccacauccaggacacccaggauauauaaauuucucauacgaaguauuaacaccacuaaaaugguaucaaucaaugauaagaccaccauacagcucauacggauacgaaccaaugggaggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6800 - RNA, 519 nt, Artificial Sequence
  mRNA product Design5 comprising derived and/or modified sequence from Homo sapiens__NP_001134.1__HLA-A2-SP_HsAMELY(17-48,169-192) (opt6)
gggagagucccgcagucggcguccagcggcucugcuuguucgugugugugucguugcaggccuuauucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaucaaucaaugauaagaccaccaccaauacuaccagaccuacaccuagaagcauggccagcaacagacaaaacaaaacaagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6801 - RNA, 846 nt, Artificial Sequence
  mRNA product Design5 comprising derived and/or modified sequence from Sus scrofa__NP_999071.1__SsAMELX-001-1 (opt6)
gggagagucccgcagucggcguccagcggcucugcuuguucgugugugugucguugcaggccuuauucaagcuuaccaugggaaccuggauauuauucgcaugccuacuaggagccgcauucuccaugccacuaccaccacacccaggacacccaggauacauaaacuucucauacgaaguauuaaccccauuaaaaugguaucaaaacaugauaagacacccauacacaucauacggauacgaaccaaugggaggauggcuacaccaccaaauaauaccaguaguaucccaacaaacaccacaaucacacgcacuacaaccacaccaccauauaccaaugguaccagcacaacaaccaggaauaccacaacaaccaaugaugccacuaccaggacaacacucaaugacaccaacacaacaccaccaaccaaaccuaccacuaccagcccaacaaccauuccaaccacaaccaguacaaccacaaccacaccaaccacuacaaccccaauccccaaugcacccaauacaaccacuacuaccacaaccaccacuacccccaauguucucaaugcaaucacuacuaccagaccuaccacuagaagcauggccagccacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6802 - RNA, 414 nt, Artificial Sequence
  mRNA product Design5 comprising derived and/or modified sequence from Sus scrofa__NP_999071.1__SsAMELX-TRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaaauaugauaagacacccauacacaucauacggauacgaaccaaugggaggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6803 - RNA, 447 nt, Artificial Sequence
  mRNA product Design5 comprising derived and/or modified sequence from Sus scrofa__NP_999071.1__SsAMELX-LRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6804 - RNA, 486 nt, Artificial Sequence
  mRNA product Design5 comprising derived and/or modified sequence from Sus scrofa__NP_999071.1__HLA-A2-SP_SsAMEL(17-61) (opt6)
gggagagucccgcagucggcguccagcggcucugcuuguucgugugugugucguugcaggccuuauucaagcuuaccauggcaguaauggcaccaagaacauuaguacuacuacuaucaggagcacuagcacuaacacaaacaugggcaaugccacuaccaccacauccaggacacccaggauauauaaauuucucauacgaaguauuaacaccacuaaaaugguaucaaaauaugauaagacauccauauacaucauacggauacgaaccaaugggaggaugguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6805 - RNA, 519 nt, Artificial Sequence
  mRNA product Design5 comprising derived and/or modified sequence from Sus scrofa__NP_999071.1__HLA-A2-SP_SsAMEL(17-49,167-189) (opt6)
gggagagucccgcagucggcguccagcggcucugcuuguucgugugugugucguugcaggccuuauucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6806 - RNA, 810 nt, Artificial Sequence
  mRNA product Design5 comprising derived and/or modified sequence from Sus scrofa__P45561-2__SsAMELX-001-2 (opt6)
gggagagucccgcagucggcguccagcggcucugcuuguucgugugugugucguugcaggccuuauucaagcuuaccaugggaacauggauacuauucgcaugccuacucggugcagcauucucaaugccacuaccaccacacccaggacacccaggauacauaaacuucucauacauacgacacccauacacaucauacggauacgaaccaaugggaggauggcuacaccaccaaauaauacccguaguaucucaacaaacaccacaaucacacgcacuacaaccacaccaccacauaccaaugguaccagcacaacaaccaggaauaccacaacaaccaaugaugccauuaccaggacaacacucaaugacaccaacacaacaccaccaaccaaaccuaccacuaccagcacaacaaccuuuccaaccacaaccaguacaaccacaaccacaccaaccacuacaaccacaaucaccaaugcacccaauacaaccauuacuaccacaaccaccacuaccaccaauguucucaaugcaaucacuacuaccagaccuaccacuagaagcauggccagcaacagacaaaaccaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6807 - RNA, 846 nt, Artificial Sequence
  mRNA product Design5 comprising derived and/or modified sequence from Sus scrofa__NP_998965.1__SsAMELX-001-3 (opt6)
gggagagucccgcagucggcguccagcggcucugcuuguucgugugugugucguugcaggccuuauucaagcuuaccaugggaacauggauauucuucgccugccuacuaggcgcaucacuagcaaugccacuaccaccacacccaggacacccaggauauauaaacuucucauacgaaguacuaacaccucuaaaaugguaccaaaacaugauaagacauccauacacaucauacggauacgaaccaaugggcggaugguuacaccaccaaauaauaccaguagucucccaacaaacaccacaaucacacgcauuacaaccccaccaccacauacccaugguaccagcccaacaaccaggaauaccacaacaaccaaugaugccacuaccaggacaacacucaaugacaccaacacaacaccaccaaccaaaccucccauuaccagcacaacaacccuuccaaccacaacccguacaaccacaaccacaccaaccacuacaaccacaaucaccaaugcacccaauacaaccacuacuaccccaaccaccacuaccaccaauguucucaaugcaaucacuacuacccgaccuaccauuagaagcauggccagcaacagacaaaacaaaaagagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6808 - RNA, 495 nt, Artificial Sequence
  mRNA product Design5 comprising derived and/or modified sequence from Sus scrofa__K7GPB2__SsAMELX-002 (opt6)
gggagagucccgcagucggcguccagcggcucugcuuguucgugugugugucguugcaggccuuauucaagcuuaccaugggaacauggauacuauucgcaugccuacuaggagcagcauucucaaugccacuaccaccacacccaggacacccaggauacauaaacuucucauacgaaguacuaacaccacuaaaaugguaucaaaacaugauaagacacccaucacuauuaccagaccuaccacuagaagcauggccagcaacagacaaaacaaaaagagaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6809 - RNA, 888 nt, Artificial Sequence
  mRNA product Design5 comprising derived and/or modified sequence from Sus scrofa__K7GLD0__SsAMELX-003 (opt6)
gggagagucccgcagucggcguccagcggcucugcuuguucgugugugugucguugcaggccuuauucaagcuuaccaugggaacauggauacuauucgcaugccuacuaggagccgcauucucaaugccccuaccaccacacccaggacacccaggcuacauaaacuucucauacgaagaccuauaccuagaagcaauaagaauagacagaacagcauucguccuaacaccauuaaaaugguaccaaaacaugauaagacacccauacacaucauacggauacgaaccaaugggaggcuggcuacaccaccaaauaauacccguaguaucccaacaaacaccacaaucacacgcacuccaaccacaccaucacauaccuaugguaccagcacaacaacccggaauaccacaacaaccaaugaugccacuaccaggacaacacucaaugacaccuacacaacaccaccaaccaaaccuaccauuaccagcacaacaaccauuccaaccacaaccaguacaaccacaaccacaccaaccccuacaaccacaaucaccaaugcacccaauacaaccacuacucccacaaccaccccuaccacccauguucucaaugcaaucuuuacuaccagauuuaccauuagaagcauggccagcaacagacaaaacaaaaagagaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6810 - RNA, 774 nt, Artificial Sequence
  mRNA product Design5 comprising derived and/or modified sequence from Sus scrofa__K7GPE9__SsAMELX-004 (opt6)
gggagagucccgcagucggcguccagcggcucugcuuguucgugugugugucguugcaggccuuauucaagcuuaccaugggcacauggauacuauucgcaugccuacuaggagcagcauucuccaugccacuaccaccacacccaggacacccaggauacauaaacuucucauacgaaguacucaccccacuaaaaugguaccaaaacaugauaagacacccaacaccacaaucccacgcacuccaaccacaccaccacauaccaaugguaccagcacaacaaccaggaauaccacaacaaccaaugaugccacuaccaggacaacacucaaugacaccaacacaacaccaccaacccaaccuaccacuaccagcacaacaaccauuucaaccacaaccaguacaaccacaaccacaccaaccacuacaaccacaaucaccaaugcacccaauacaaccacuacucccacaaccaccacuacccccaauguucucaaugcaaucacuauuaccagaccuaccacuagaagcauggccagcaacagacaaaacaaaacgagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6811 - RNA, 798 nt, Artificial Sequence
  mRNA product Design5 comprising derived and/or modified sequence from Sus scrofa__J9JIM4__SsAMELX-201 (opt6)
gggagagucccgcagucggcguccagcggcucugcuuguucgugugugugucguugcaggccuuauucaagcuuaccaugccacuaccaccacacccaggacacccaggauacauaaacuuuucauacgaaguacuaaccccacuaaaaugguaccaaaacaugauaagacaccccuacacaucauacggcuacgaaccaaugggaggauggcuacaccaccaaauaauaccaguaguaucacaacaaacaccacaaucacacgcacuccaaccacaccaccacauaccaaugguaccagcacaacaacccggaauaccacaacaaccaaugaugccacucccaggacaacacucaaugacaccaacacaacaccaccaaccaaaccuaccacuaccagcccaacaaccauuccaaccacaaccaguacaaccacaaccacaccaaccacuacaaccacaaucaccaaugcacccaauacaaccacuacuaccacaacccccacuacccccaauguucucaaugcaaucacuacuaccagaccuaccacuagaagcauggccagcaaccgacaaaacaaaaagagaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6812 - RNA, 3237 nt, Artificial Sequence
  mRNA product Design5 comprising derived and/or modified sequence from Homo sapiens__NP_006120.1__HsBMP1 (opt6)
gggagagucccgcagucggcguccagcggcucugcuuguucgugugugugucguugcaggccuuauucaagcuuaccaugccagggguagcuagacuaccucuacucuuaggacuccuauuguuaccacggccaggaagaccguuagaucuagcggacuacacauaugaucucgcagaagaagacgacagugaaccgcuaaauuacaaagauccauguaaagcggccgcauuuuugggagauauagcauuagaugaagaagacuuaagagcauuucaaguacaacaagcuguugaucuaagaagacacacggcccgaaaaagcaguauaaaagcagcgguaccaggcaacacaagcacgccaucaugccaaaguacaaacggacaaccacaaagaggggcuugcgggagauggagaggaagaagcagaagcagacgcgcagcuacuucaagaccugaaagaguuuggccugacggcguaauaccauucguaauaggaggcaauuuuacaggaagucagcgcgcaguuuuucggcaagcaaugcgccacugggaaaaacauacuuguguaacauucuuagagcgaacagaugaagauuccuauauaguuuucacauacaggcccugcggauguuguucauauguaggaagacgcgggggaggaccacaagcgauaaguauaggaaaaaauugugacaaauucggaauaguuguccaugaauuaggucacguugugggauucuggcacgaacacacacgaccagauagagacagacauguaaguauaguaagggaaaauauacaaccagggcaggaauacaacuuuuuaaaaauggaaccccaagagguagaaucacuuggcgaaacuuacgauuucgauaguauaaugcauuaugcuagaaauacauuuucgagaggaauauuccuagacacuauaguaccgaaauacgaaguaaauggagugaaacccccaauaggccaaagaacuagacuaucaaaaggagacauagcacaggcaagaaaauuauauaaaugucccgcguguggugaaacauuacaagauucuacaggaaauuuuucaucuccugaauauccuaauggcuauagugcacacaugcauuguguauggcgcauuucaguaacaccaggagaaaaaauuauuuugaauuucacaagucuagacuuauacagaaguagauuauguugguaugacuauguagaagucagggauggauucuggagaaaagcuccucuaaggggaagauuuuguggaagcaaauuaccugaaccaauaguuagcacagauucaagacuuuggguagaauuuagaaguaguucaaauuggguaggaaaaggauuuuucgcaguguaugaagcaauuugcgguggagauguaaaaaaagacuaugggcacauacaaagcccaaacuauccugaugauuauagaccaucaaaaguauguauauggcgaauacaaguuagugaaggguuucacguaggauuaacuuuucaauccuucgaaauagaaagacaugacucuugcgcauaugauuauuuagaaguuagagacggacauagugagaguaguacucuaaucggaagauacugcggcuaugaaaaaccugaugacauuaaaagcacuagcucuagauuauggcuaaaauuuguaagugaugguagcauaaauaaggcagguuuugcaguaaacuuuuuuaaagagguugaugaauguucgaggccuaauagaggugguugugaacaacggugcuugaauacacuaggaagcuacaaaugcucaugcgauccaggcuacgaauuagcgccagauaaaagaagaugugaagcagcauguggaggauuuuugacuaaacuaaauggaucaauaacaaguccagguuggccgaaagaauacccuccuaauaaaaacuguauuuggcaacuuguagcaccuacucaauauagaauaucauugcaauucgauuuuuucgagacagaaggaaacgacguauguaaauaugacuuuguggaaguaagaaguggucuaaccgcugauaguaagcuacacggaaaauucugcgguagugagaaaccagaaguaauaacgucacaauacaauaauaugagaguugaauuuaagagugacaauacaguuucaaaaaaaggauuuaaagcacauuuuuucucagacaaagaugaguguaguaaagauaauggaggaugccagcaagacugcguaaauacauucggaagcuaugaaugucaaugucgauccggcuuuguauuacacgauaauaaacacgauuguaaagaagcuggaugcgaucacaaaguaacgaguacuagcggaacaauuacaagcccaaauuggccggacaaauaucccucaaaaaaagaauguacuugggcaauaucuucuacaccgggucauagagugaaauuaacauucauggaaauggacauagaaucacaaccagaaugugcauaugaucaccuugaaguauucgaugguagagaugcuaaagcuccaguacugggucgcuuuuguggaaguaaaaaacccgagccuguauuagcaacaggaucaagaauguuccuuagauucuacuccgacaauucaguacagagaaaagguuuccaagcuucucacgcaacagaauguggaggccaagugcgagcggauguaaaaacaaaagacuuauauucucacgcacaguuuggagacaauaauuauccaggagguguggauugugaauggguuauagucgcagaagaaggauacggaguagagcuagucuuucaaacauuugagguagaagaagaaacugauuguggauacgacuauauggaacucuuugauggauacgacucaacagcaccccgauuagguagauauuguggaucuggaccacccgaagaaguauauuccgcaggagacagcguauuagucaaguuccacuccgaugauaccaucacuaaaaaaggauuucaucuuagauauacaagcacaaaauuucaagacacucuucacagccgaaaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6813 - RNA, 1467 nt, Artificial Sequence
  mRNA product Design5 comprising derived and/or modified sequence from Homo sapiens__NP_001191.1__HsBMP2 (opt6)
gggagagucccgcagucggcguccagcggcucugcuuguucgugugugugucguugcaggccuuauucaagcuuaccaugguagcugguacuagaugccuacuagcauuacucuuaccacaaguauuacuaggaggagcagcaggauuagucccagaacuagguagaagaaaauucgcagcugccucaucaggaagacccagcucacaaccuucagacgaaguccuaucagaauuugaauugagauuacuaucaauguucggacuuaaacaaagaccaacaccaucaagagaugcaguaguaccaccauauaugcuagauuuauauagaagacacucaggacaaccaggaaguccagcuccagaccauagauuagaaagagcagcaaguagagcaaacacagucaggagcuuucaucacgaagaaucacuagaagaauuaccagaaacaucaggaaaaaccacaagaagauuuuucuuuaaccuuaguucaauaccaacagaagaauucaucacaagugcagaacuacaagucuucagggaacaaaugcaggacgcacuaggaaauaauucaucauuccaucauagaauaaauaucuaugaaauaauaaaaccagcaacagccaacucaaaauucccaguaacaagacuacuagacacaagacuaguaaaccaaaacgcaagcagaugggaaagcuuugauguaacaccagcaguaaugcgauggacagcacaaggucacgcaaaucacggauucguagucgaagucgcgcaucuagaagaaaaacaagguguaagcaaacgacauguaagaauaaguagaaguuuacaccaagaugaacauucauggucacaaauaagaccacuccuaguaacauucggacaugacgguaaaggacacccacuacacaaacgagaaaaaagacaagcaaaacauaaacaaagaaaaagacuaaaaucaucaugcaaaagacauccguuauauguugacuuuucagauguaggauggaacgacuggaucguagcacccccaggauaucacgcauucuauugucauggagaauguccauuuccauuagcagaucacuuaaauagcacaaaccacgccauuguacaaacucuagucaauucagucaauucaaaaaucccaaaagcaugcugcguaccuacagaacuaucagcaauuucaaugcuauaccuagacgaaaaugaaaaaguaguacuuaaaaacuaucaagacaugguuguagaaggauguggaugcagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6814 - RNA, 1503 nt, Artificial Sequence
  mRNA product Design5 comprising derived and/or modified sequence from Homo sapiens__NP_001193.2__HsBMP4 (opt6)
gggagagucccgcagucggcguccagcggcucugcuuguucgugugugugucguugcaggccuuauucaagcuuaccaugauacccggaaacagaaugcuaaugguaguauuacuaugccaaguauuacuaggaggagcuagccaugccagcuuaauuccugaaacaggcaaaaagaaaguagcagaaauacaaggacacgcaggaggaagaagaucaggacaaagccaugaacuacuaagagacuucgaagcaacauuacuacaaauguuuggacuacgacgaagaccacaaccuaguaaaagcgcagucauaccagacuauaugagagaucuauaucgcuuacaaagcggagaagaagaagaagaacaaauacauucaacaggauuagaauacccagaaagacccgcaucaagagcaaauacagugaggucauuccaucaugaagaacaucuagaaaauauaccaggaacaucagaaaauucagcauucagauuuuuauucaauuuaaguucuauaccagaaaacgaaguaauaucaucugcagaacuaagauuauucagagaacaaguugaucaaggaccagacugggaaagagguuuucacagaauaaauaucuaugaaguaaugaaaccuccagcagaaguaguuccagggcaucuaaucacaagauuacucgauacaagauuaguacaccauaacguaacacgaugggaaacauuugauguaucaccagcaguucuaagauggacaagagaaaaacaaccgaauuacggauuagcaauagaaguuacucacuuacaucaaacaagaacccaccaaggacaacauguaagaauaucccgaucauuaccacaaggcucaggaaauugggcacaacuaagaccacuccucguaacauuuggacaugacggaagaggacaugcucucaccagaagaagacgagcaaaaagaucaccaaaacaccauagccaaagagcuagaaagaaaaauaaaaauugcagaagacauaguuuauacguugacuucucagauguaggauggaaugauuggauaguagcaccaccugguuaccaagcauuuuauugucacggagacuguccauuuccuuuagcagaucacuuaaacaguacaaaucacgcaauaguacaaacucuaguuaacucaguaaacagcucuauaccaaaagcaugcugugucccaacagaacuaucggcaauuucaauguuauauuuagaugaauaugauaaaguaguacuuaaaaauuaucaagaaaugguaguagaaggaugcggauguagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6815 - RNA, 1818 nt, Artificial Sequence
  mRNA product Design5 comprising derived and/or modified sequence from Homo sapiens__NP_001709.1__HsBMP6 (opt6)
gggagagucccgcagucggcguccagcggcucugcuuguucgugugugugucguugcaggccuuauucaagcuuaccaugccaggauuaggucguagagcacaaugguuaugcugguggugggguuuacuauguucauguuguggcccaccaccccuaagaccaccauuacccgcagcagcggcugcagccgcaggaggacaacuauuaggagauggaggaaguccaggcagaacagaacaaccaccgccaagcccccaaagcucaucuggauuucuauacagaagauuaaaaacacaagaaaagagagaaaugcaaaaagaaauacuaucgguauuaggacugccacaucgacccagaccacuacacggauuacaacaaccccaaccacccgcacuucgacaacaagaagaacaacaacaacaacaacaacuaccaagaggcgaaccuccaccaggaagauuaaaaucagcaccacuauuuauguuagauuuauauaacgcauuaucagcagacaaugacgaagacggagcaucagaaggagaaagacaacaaucauggccccaugaagcagcaucaaguucacaacgaagacaaccaccuccaggagcugcucauccauuaaacagaaaaucacuucucgccccaggaaguggcucuggaggugcaaguccauuaacaucagcacaagauagcgcuuucuuaaaugaugcagauaugguaaugucauuuguaaaucuagucgaauacgauaaagaauuuucaccaagacaacgacaucauaaagaauuuaaauucaauuuaagucaaauaccugaaggugaaguaguuacagcugcugaauuucgaauauauaaagacuguguaaugggaucauuuaaaaaccaaacauucuuaauaucaauauaucaaguuuuacaagaacaucaacauagagauagugaucucuuuuuacuagauacaagaguaguaugggcuagugaagaagguugguuagaauuugacauaacagcuacgaguaauuuauggguuguaacaccacaacauaauaugggucuacaacuuagcguaguuacacgagaugguguacauguacacccaagagcagcaggucuaguaggaagggauggaccuuaugacaagcaaccauucaugguagcauucuuuaaaguaagcgaaguucauguaagaacuacaagaucagcuucaucaagaagaagacaacaaagucgaaacagaaguacacaaagucaagauguugcaagaguauccagugcaucugauuauaacaguagcgaacuaaaaaccgcauguagaaaacacgaauuauacgucagcuuucaagaucuaggauggcaagauuggauaaucgcaccaaaaggauaugcagccaauuauugugauggagaaugcaguuuuccuuuaaaugcacacaugaaugcaacaaaucacgcuauaguucaaacacuuguucacuuaaugaauccugaauacguaccaaaaccauguugcgcaccuacaaaauuaaacgcaauaucaguacuauacuuugaugauaauucaaacguaauacuuaaaaaguauagaaauaugguaguaagagcaugugguugucacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6816 - RNA, 1572 nt, Artificial Sequence
  mRNA product Design5 comprising derived and/or modified sequence from Homo sapiens__NP_001710.1__HsBMP7 (opt6)
gggagagucccgcagucggcguccagcggcucugcuuguucgugugugugucguugcaggccuuauucaagcuuaccaugcauguaagaucacuccgagcagcagcaccacacucauuuguagcauuaugggcaccacuauucuuauuaagauccgcacucgcagacuucaguuuagacaaugaaguacacucaucauuuauacaucgaagauuacgaucccaagaaaggagagaaaugcaaagagaaauacucucaauacuagguuuaccccacagaccaagaccacaccuacaaggaaaacauaauuccgcaccaauguucaugcuagaucuauacaacgcaauggcaguagaagaaggaggaggaccaggaggccaagguuucucauacccauauaaagcaguauucaguacacaaggaccuccacuagcaucccuacaagauucucacuucuuaacugaugcagauauggucaugucauucguuaacuuaguagaacaugauaaagaauuuuuucacccaagauaucaccaucgugaauuuagauucgaccuaucaaaaauuccagaaggagaagccguaacagcagcagaauucaggauuuauaaagacuauauccgagaacgauucgacaacgaaacauucagaauaucaguauaucaagucuuacaagaacaucucggccgagaaucagacuuauucuuauuagauucgagaacucuaugggcaucugaagaaggaugguuaguauuugauauaacagcaacaagcaaucauuggguaguaaacccccgacauaaucuaggauuacaauuaucaguagaaacacuugauggccaaagcauuaacccaaaauuagcaggacuaauaggcagacaugguccacaaaacaaacaaccauucaugguagcauuuuucaaagcaacagaaguccauuucagaaguauaagaucaacaggaaguaaacaaagaucacaaaacagaucaaaaacaccaaaaaaucaagaagcacuaagaauggcuaacguagcagaaaauagcucuagugaccaaaggcaagccuguaaaaaacacgaauuauauguaucauucagagauuuaggauggcaagauuggaucauagcaccagaaggauaugcagcauauuacugugaaggagaaugugcuuucccauuaaacucauacaugaacgcaacaaaucacgcaaucguacaaacacucguacacuuuauuaauccagaaacaguaccaaaacccugcugcgcacccacacaauuaaacgcaauaucaguacuauacuuugacgauucaucaaacguaauauuaaaaaaauacagaaacauggucguaagagcaugugguugccauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6817 - RNA, 576 nt, Artificial Sequence
  mRNA product Design5 comprising derived and/or modified sequence from Homo sapiens__NP_006264.2__HsCCL7 (opt6)
gggagagucccgcagucggcguccagcggcucugcuuguucgugugugugucguugcaggccuuauucaagcuuaccaugaaagcaucagcagcacuacuaugccuacuacuaacagcagcagcauucucaccacaaggacuagcacaaccaguaggaauaaacacaucaacaacaugcugcuacagauucauaaacaaaaaaauaccaaaacaaagacuagaaucauacagaagaacaacaucaucacacugcccaagagaagcaguaauauucaaaacaaaacuagacaaagaaauaugcgcagacccaacacaaaaauggguacaagacuucaugaaacaccuagacaaaaaaacacaaacaccaaaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6818 - RNA, 3900 nt, Artificial Sequence
  mRNA product Design5 comprising derived and/or modified sequence from Homo sapiens__NP_001954.2__HsEGF (opt6)
gggagagucccgcagucggcguccagcggcucugcuuguucgugugugugucguugcaggccuuauucaagcuuaccauguuacuaacuuugauaauauuauuaccaguuguuucaaaauuuucuuuugugucauuaucugcaccgcaacacuggaguuguccagaaggaacucuagcuggaaauggaaauucuacauguguugggccugcaccauuucuaauauucagccauggaaacucaauuuucagaauagauacugagggaaccaacuaugagcaacucguugucgacgcuggaguaucuguaauaauggauuuucauuacaaugagaaacgcauauacuggguugacuuagaacgacaauuauuacaaagaguauuucuaaauggaagcagacaagaaaggguaugcaauauagagaaaaaugugaguggaauggcaaucaauuggauaaaugaagaagugauauggucaaaccaacaagaaggaauuauaacaguaacagauaugaaaggcaauaauagccauauacuguugagcgcccuuaaauauccagcuaacguagcaguagauccaguagaaagauuuauauuuuggaguucugaagucgcaggaucacuauaccgagcugaccuugauggaguagguguaaaggcuuuacuagaaacaucagagaaaaucacagcaguaagucuugacguacuagauaaaagauuauucuggauccaauauaaccgcgaagggucuaauucccuuauauguucaugugacuacgacggaggcucaguacauauaucaaaacauccgacccaacauaaucuauuugcuaugagccuuuucggggacagaaucuuuuauucgacauggaaaaugaaaacaauuuggauagcaaauaaacacacaggaaaagacaugguaagaauuaauuuacauagcucuuucguaccuuugggagaauuaaaaguaguacauccguuggcacagccuaaagcagaagacgauacaugggaaccugaacaaaaauugugcaaauugcgaaaaggaaacuguucaucgaccguuuguggacaagacuuacaaagucacuugugcaugugugcggaaggauaugcucuauccagagauagaaaauauugugaagaugucaacgaaugugcuuuuuggaaucauggaugcacacuaggaugcaaaaacacaccagguucuuauuacuguaccuguccaguagguuuuguuuuacuaccagacgguaaaagaugucaccagcuaguaucguguccacgcaacguaucugaauguucucacgauuguguacuuaccagcgaaggaccauuauguuuuuguccggagggaaguguacuagaacgugacgguaaaacauguucaggaugcucaucaccugauaacggugguuguagucaauuaugcgucccacuuaguccuguaaguugggaaugugacugcuucccaggauaugauuugcaauuagaugagaaaagcugugcagccagcggaccucaacccuuucuccuuuucgcaaacagccaagauauaagacauaugcauuuugauggaacugauuauggaacgcuauuaagucaacaaaugggaaugguuuacgcacuagaucaugauccuguagaaaauaaaauauauuuugcucacacagccuuaaaauggauagaacgggcaaauauggacgguagccaaagagaacgacuaaucgaagaaggaguagauguuccugaaggauuagcaguagauuggaucggaagacgauuuuauuggacggauaggggaaaaagccuaauugguagauccgaccuuaauggaaaaagaucaaaaauaauaacaaaagaaaacauaagccaaccacgcggaauugcgguacauccaauggcaaaacggcuauuuuggacagauacaggaauaaacccaagaauagaaaguucuucuuuacagggacuaggacgucuaguaauagcaagcuccgauuuaauuuggcccagugguauaacgauagacuuuuuaacugauaaacuauacuggugugaugcaaagcaaucagucauugaaauggcaaaucuagauggaucuaaaagaagaagacuaacucaaaacgauguaggacacccauuugccguagcaguauuugaagauuauguuugguucucagauugggcaaugccaagcguaaugagaguaaauaaaagaacaggaaaagauagagucagauugcaaggaagcauguuaaaaccguccagucuugucgucguucauccccuugcaaaaccaggugcggauccaugucuauaucaaaacggaggaugugaacauauuugcaagaaacgguuagguacugcauggugcagcugucgagaaggauucaugaaagcgagcgaugguaaaacauguuuagcacucgauggacaucaacuacuagcuggcggagaaguagaccugaaaaaccaagugacaccccuugauauacuuaguaaaaccagaguaagugaagauaauauaacggaaucacaacauauguuaguagcagaaaucauggugagcgaucaagaugauugugcacccguaggauguaguauguaugcaagaugcaucucagaaggagaagacgcaaccugccagugcuuaaaaggcuuugccggcgacggcaaacugugcucagauauugaugagugcgaaaugggugugcccguuuguccuccagcgucauccaaauguauaaauacagaaggagguuauguauguagaugcagcgaggguuaucaaggugauggcauacacuguuuggauaucgaugaaugucaauuaggagaacauucuuguggggaaaaugcaaguuguacaaauacagaaggagguuauacuuguaugugugcuggccguuuaagugaaccuggcuuaauauguccagacagcacuccgccuccucaccuaagagaggaugaucaccauuacagcguacgcaauagcgauucagaaugcccucuaagucacgacggguacugucuacaugacggaguauguauguacauagaggcuuuagauaaguaugcauguaacugugucguugguuacauaggagaaagaugucaauaucgagauuuaaaauggugggaauuaagacacgcgggacauggccaacaacaaaaaguaauagucguagccgucugcguaguuguucuaguaauguuacuacuacugagucuuuggggugcacacuauuauagaacacaaaaacuacuaucgaaaaaucccaaaaauccauaugaagaaagcaguagagauguaaggucaagacgaccggcugacacagaagaugggaugucaaguugcccacaaccaugguuuguaguaauaaaagagcaucaagaccuuaaaaacggaggucagccaguagcuggagaagacggucaggcugcggaugggaguaugcaaccaacaucuuggagacaagaaccucaacugugcggaauggguacggagcaaggcugcuggaucccugucagcucagacaaaggcagcuguccucaagugauggaacgaucauuccauaugccgucauacgggacacaaacguuggaaggaggaguggaaaaaccacauagucuauuauccgcaaacccauuauggcaacaacgagcauuagauccaccucaucaaauggaauuaacucaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6819 - RNA, 786 nt, Artificial Sequence
  mRNA product Design5 comprising derived and/or modified sequence from Homo sapiens__NP_001423.1__HsEREG (opt6)
gggagagucccgcagucggcguccagcggcucugcuuguucgugugugugucguugcaggccuuauucaagcuuaccaugacagcagguagaagaauggaaauguuaugcgcaggaagaguacccgcacuacuacuaugccuaggauuccaccuauuacaagcaguacuaucaacaacaguaauaccaagcugcauaccaggagaaucaucagacaacugcacagcacuaguacaaacagaagacaauccaagaguagcacaaguaucaauaaccaaaugcucaucagacaugaacggauacugcuuacacggacaaugcauauaccuaguagacaugucacaaaacuacugcagaugcgaagucggauacacaggaguaagaugugaacacuuuuuucuaacaguacaucaaccacuaucaaaagaauacguagcacuaacaguaauauuaauaauacuauuucuaauaacaguagucggaucaacauacuacuucugcagaugguacagaaacagaaaaucaaaagaaccaaaaaaagaauacgaaagaguaacaucaggagacccagaacuaccacaaguauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6820 - RNA, 744 nt, Artificial Sequence
  mRNA product Design5 comprising derived and/or modified sequence from Homo sapiens__NP_000791.1__HsFGF1 (opt6)
gggagagucccgcagucggcguccagcggcucugcuuguucgugugugugucguugcaggccuuauucaagcuuaccauggcagaaggagaaauaacaacauucacagcacuaacagaaaaauucaaccuaccaccaggaaacuacaaaaaaccaaaacuacuauacugcucaaacggaggacacuuccuaagaauacuaccagacggaacaguagacggaacaagagacagaagcgaccaacacauacaacuacaacuaucagcagaaucaguaggagaaguauacauaaaaucaacagaaacaggacaauaccuagcaauggacacagacggacuacuauacggaucacaaacaccaaacgaagaaugccuauucuuagaaagacuagaagaaaaccacuacaacacauacauaucaaaaaaacaugcagaaaaaaacugguucguaggacuaaaaaaaaacggaucauguaaaagaggaccaagaacacacuacggacaaaaagcaauacuauuccuaccauuaccagucucaagcgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6821 - RNA, 1143 nt, Artificial Sequence
  mRNA product Design5 comprising derived and/or modified sequence from Homo sapiens__NP_001997.5__HsFGF2 (opt6)
gggagagucccgcagucggcguccagcggcucugcuuguucgugugugugucguugcaggccuuauucaagcuuaccaugguugggguaggaggaggagacguagaagauguaacaccaaggccaggaggaugucaaauaagcggaagaggagcaagaggauguaaugggauaccaggagcggcagcaugggaagcugcauuaccaagaagaagaccuaggagacauccaaguguuaauccaagaucuagagcagcggggaguccaagaacaagaggaagaagaacagaagaaagaccaagugggucaagauuaggagauagagguagggggagagcauuaccagguggaagauuaggagguagaggaagaggaagagcaccagaaagagugggaggaagaggaaggggaagaggaacagcagcaccaagagcagcaccagcugcaagaggaaguagaccagggccggcaggaacaauggcagcaggaaguauaacaacauuaccagcauuaccagaagacggaggaucaggagcauuuccaccaggacauuuuaaagacccaaaaagauuauauuguaaaaacggaggauuuuuucuaagaauacauccagauggaagagucgauggugugagggaaaaaagugauccgcauauaaaauuacaauuacaagcagaagaacgaggaguuguaaguauaaaaggaguaugugcaaauagauaucuagcaaugaaagaagauggaagauuauuagcaaguaaauguguaacagacgaauguuuuuuuuuugaaagauuagaaagcaauaauuauaauacuuauagaaguagaaaauauacaagcugguauguagcuuuaaaaagaacaggacaauauaaacuaggaaguaaaacaggaccaggacaaaaagcaauacuauuucuaccaaugagcgcaaagucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6822 - RNA, 861 nt, Artificial Sequence
  mRNA product Design5 comprising derived and/or modified sequence from Homo sapiens__NP_002000.1__HsFGF7 (opt6)
gggagagucccgcagucggcguccagcggcucugcuuguucgugugugugucguugcaggccuuauucaagcuuaccaugcacaaauggauacuaacauggauacuaccaacacuacuauacagaagcugcuuccacauaauaugccuaguaggaacaauaagccuagcaugcaacgacaugacaccagaacaaauggcaacaaacguaaacugcucaucaccagaacgacacacaagaucauacgacuacauggaaggaggagacauacgaguaagaagacuauucugcagaacacaaugguaccuaagaauagacaaaagaggaaaaguaaaaggcacucaagaaaugaaaaacaacuacaacauaauggaaauaagaacaguagcagucggaaucguagcaauaaaaggaguagaaucagaauucuauuuagcaaugaacaaagaaggaaaacuauacgcaaaaaaagaaugcaacgaagacugcaacuucaaagaauuaauacuagaaaaccacuacaacacauacgcaucagccaaauggacacacaacggaggagaaauguucguagcacuaaaccaaaaaggaauaccaguaagaggaaaaaaaacaaaaaaagaacaaaaaacagcacacuuccuaccaauggcaauaacauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6823 - RNA, 903 nt, Artificial Sequence
  mRNA product Design5 comprising derived and/or modified sequence from Homo sapiens__NP_001936.1__HsHBEGF (opt6)
gggagagucccgcagucggcguccagcggcucugcuuguucgugugugugucguugcaggccuuauucaagcuuaccaugaaacuacuaccaucaguaguacuaaaacuauuuuuagcagcaguacuaucagcacuaguaacuggagaaucacuagaaagauuaagaagaggacuagcagcaggaaccucaaauccagacccaccaacaguaagcacagaccaauuauuaccacuaggaggaggaagagacagaaaaguaagagaccuacaagaagcagaccuagaccuauuaagaguaacacuaucaucaaaaccacaagcacuagcaacaccaaacaaagaagaacacggaaaaagaaaaaaaaaaggaaaaggacuaggaaaaaaaagagacccaugccuaagaaaauauaaagacuucugcauacacggagaaugcaaauacgucaaagaacuaagagcaccaagcugcauaugccaccccggauaccauggagaaagaugccacggacuaucacuaccaguagaaaaccgacuauacacauacgaucacacaacaauauuagcaguaguagcaguaguauuaucaucaguaugcuuacuaguaauaguaggacuauuaauguucagauaccacagacgaggaggauacgauguagaaaaugaagaaaaaguaaaacuaggaaugacaaauucacauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6824 - RNA, 2463 nt, Artificial Sequence
  mRNA product Design5 comprising derived and/or modified sequence from Homo sapiens__NP_000592.3__HsHGF (opt6)
gggagagucccgcagucggcguccagcggcucugcuuguucgugugugugucguugcaggccuuauucaagcuuaccauguggguaacuaaacuuuuaccagcguuauuacuccaacacguauuacuacaccuccuauuauuaccaauagcuauaccauaugcagaaggacaaagaaaacgcagaaacaccauacaugaauuuaaaaaaucggccaaaacaacucuaaucaaaauagauccagcauuaaaaauaaaaacaaaaaaaguuaacacagccgaucaaugugcaaaccgcugcacacguaauaaaggccuaccauucacaugcaaagcauuuguauuugauaaagcacguaagcaaugucuaugguuuccauuuaauagcaugagcucuggcguaaaaaaagaauuuggacaugaauuugaccuauacgaaaauaaagacuauauuagaaacuguauuauaggaaaaggaagaucauauaagggcacaguauccauaacaaaaucaggaauuaaaugucaaccauggucauccaugauaccccacgaacauucauuuuuaccaucaaguuauagaggaaaagauuuacaagaaaacuauugccgaaacccaagaggagaagaaggcggaccuugguguuuuacaucaaacccagaagucagauaugaaguuugugauauaccccaauguucagaaguagaauguaugacauguaauggagaaucauauagaggucuaauggaucacacagaaagugguaagauaugccaaagaugggaucaucagacaccacaccgacauaaauuuuuacccgaaagauacccugauaaaggauuugaugauaauuacugucgaaacccugaugggcagccaagaccaugguguuauacuuuagacccccacacaagaugggaauauugcgcuauaaaaacaugcgcggauaauacaaugaaugauacagauguacccuuagaaacuacugaauguauacaaggacaaggugaggguuaucgcggcacugucaauacuauauggaauggcauccccugucaaagaugggauucacaauauccccaugaacaugauaugacaccagaaaacuuuaaauguaaagauuuacgagaaaauuauugccguaauccagaugguucagaaucucccuggugcuuuacaaccgauccaaauaucagagucggguacuguucacagauaccaaauugcgacaugucucauggucaagauuguuauaggggaaacggaaaaaauuauaugggaaacuuaucucaaacuagaucagguuuaacuuguaguaugugggauaaaaauauggaagauuuacacagacauauauucugggaaccugaugcaagcaaacuaaacgaaaacuacuguaggaauccagacgaugaugcacauggcccuuggugcuauacaggaaauccauuaaucccgugggauuauugucccauaucgcgaugugaaggcgacacaacgccaacuauaguaaaccuagaucauccagugauaucaugugcaaaaacuaaacaauuaagagucguaaauggaauaccaacaagaacaaacauuggauggaugguaucacuccgauacagaaauaaacauauauguggaggaucauuaauaaaagaaagcuggguuuuaaccgcaagacaauguuuuccaucucgagaccuuaaagacuaugaagcaugguuaggaauacacgacguacaugguagaggagacgaaaaauguaaacaaguacuaaauguuucccaacuuguauaugguccagaagguucagauuuaguauuaaugaaauuagcgagacccgcaguuuuagaugauuucguaagcaccauagaccuaccgaauuauggauguacuauaccagaaaaaacaaguuguaguguauacggauggggauauacaggccuaauaaauuaugacggauuacuaagagucgcacacuuauauauaaugggaaacgaaaaauguucacaacaucacagagguaaaguaacauuaaaugaaagugaaauaugugcaggagcugaaaaaauaggcucaggaccgugugaaggagauuauggaggcccacuaguaugugaacagcacaaaaugagaaugguacuaggaguaauaguaccaggccgaggaugugcaaucccaaacagaccaggaaucuuuguuagagucgcuuacuaugcuaaauggauacauaaaauaauacuaacauauaaaguaccacaaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6825 - RNA, 2202 nt, Artificial Sequence
  mRNA product Design5 comprising derived and/or modified sequence from Homo sapiens__NP_005336.3 __HsHSPA1A (opt6)
gggagagucccgcagucggcguccagcggcucugcuuguucgugugugugucguugcaggccuuauucaagcuuaccauggcaaaagcagcagcaauuggaauagauuuggguacaacauacaguugcgugggcguguuucaacacggaaaaguagaaauaauagcaaacgaucaaggaaacaggacaacaccaucauacguggcauuuacagacacagaacgauuaauaggggacgcugcuaaaaaccaaguagcauuaaacccccaaaacacaguguucgaugcgaaaaggcuuauaggucggaaauuuggggaucccguaguccaaagcgauaugaaacauuggccauuccaagucauuaaugauggagauaaaccaaaagugcaaguaaguuacaagggugaaacaaaagcauuuuacccggaagaaauaucaaguaugguacuaacuaaaaugaaggaaauagcugaagcauaccuaggauacccaguaacaaaugcgguaauaacagugccagccuacuuuaacgauucgcaacgacaagcaacgaaagacgcaggggucauagccggucuaaaugucuuaagaauaauaaaugaaccaacagcagcagcgauagcuuacggacuagauagaacaggaaaaggugaaagaaacguacuaauauuugauuugggaggaggaacauuugacguaucgauauuaaccauagaugacggcauauuugaaguaaaggcaacggcaggagacacacaucugggaggagaagacuuugauaaucggcuaguaaaucacuuugucgaagaauuuaaaagaaaacacaagaaagauauaagucaaaacaaaagagcaguaagaagacuuagaaccgccugcgaaagagcaaaaagaacacuaagcucaucaacacaagcaaguuuggaaauagauucauuauuugaagguauagacuucuauacuucaauuacaagagccagauucgaagaacuauguagugauuuauuuagaaguacguuagaaccgguagaaaaagcguuaagagaugcuaaacuagauaaagcucaaauccaugaucuaguauuaguaggaggaaguacaagaauaccaaaagugcaaaaauuacuucaagauuucuuuaacggaagagaucuaaauaaaucgauaaauccagaugaagcgguagcguacggagcagcaguacaagcagcaauauugaugggagauaaaagugaaaacguucaagauuuauuauuacuagauguagccccauuaaguuuaggacucgagacagcugguggaguuaugacagcgcuaauaaaaaggaacucaacaauaccaacaaaacaaacacaaauauuuacaacauauagugauaaucaaccaggaguacuaauacaaguauaugaaggagaaagagcgaugacaaaagacaauaauuuacuuggaagauucgaacuuaguggaauaccaccagcaccacgaggaguaccacaaauagaaguaacguuugauauugacgcaaacggaauacuaaauguaaccgcuacagauaaaagcacaggaaaagcaaacaaaauaacuauaacaaaugauaaagguagauuaaguaaagaagaaauagaacguaugguacaagaagcagaaaaauacaaagcagaagacgaaguacaaagagaaagggucagcgcgaaaaaugcacuagaaaguuacgcauucaauaugaaaagugcaguagaagaugaaggacucaaaggaaaaauaagugaagcagauaaaaagaaagucuuagauaaaugucaagaagugauaagcuggcuagaugcaaauacauuagcugaaaaagacgaauuugaacauaaaagaaaagaacuagagcaaguaugcaacccaauaauaaguggcuuguaccaaggggcaggaggaccggggccaggaggcuuuggagcucaaggaccuaaaggaggaagcgguagcggaccaacaauagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6826 - RNA, 2202 nt, Artificial Sequence
  mRNA product Design5 comprising derived and/or modified sequence from Homo sapiens__NP_005337.2 __HsHSPA1B (opt6)
gggagagucccgcagucggcguccagcggcucugcuuguucgugugugugucguugcaggccuuauucaagcuuaccauggcaaaagcagcagcgauaggaauagauuuagggacaacuuauaguuguguaggaguauuccaacauggaaaaguagaaauaauagcuaaugaccaaggaaauagaacaacuccuaguuauguagcauuuacagacacagaaagacuaauaggagacgccgcuaaaaaucaaguagcccucaauccacagaauacaguauucgacgcaaaaagacuuauagguaggaaauucggagauccagugguacaaagcgauaugaaacauuggccauuucaaguaauaaaugacggagauaaaccaaaaguacaaguaucauacaaaggagaaacaaaagcauuuuauccugaagaaaucucaaguaugguacuaacaaagaugaaggaaauugcagaagcauaucuuggauacccaguaacgaacgcaguaauaacaguaccugccuacuuuaacgacagccaacgucaagcaacuaaagacgcaggaguaauagcuggucuaaacguacuuagaauuaucaaugaaccaacugcagccgcaaucgcauacggacuagaccgaacgggaaaaggagaaaggaauguauuaauuuucgaccuaggaggaggaacauucgaugucucuauauuaacuauagacgauggaauuuuugaaguaaaagcaacggcaggagacacgcauuuaggaggagaagauuucgauaaccgucuaguaaaucauuucguugaagaauuuaaaagaaaacauaaaaaggacauuucgcaaaauaaaagagcagugagaagauuaagaaccgccugugaaagagcaaaaagaacauuaagcagcaguacgcaagcaagccuugaaauagauucacuauuugaaggaauagauuucuacacaucaauaacaagagcucgauuugaagaauuauguagcgacuuguucagaucaacauuagagccaguagaaaaagcacuaagagacgcaaaauuagacaaagcacaaauacaugaccuaguauuaguuggaggcaguacacgaauaccaaaaguacaaaaacuucuacaagacuucuuuaauggaagagaucuaaauaaaucaauaaauccagaugaagcaguagccuacggugcggcgguucaagcagcaauacugaugggggacaaaucagaaaauguacaagauuuauuauuauuagauguggcaccacuaucauuaggauuagaaacagcuggagguguaaugacagcacuaauuaaacgaaacagcaccauaccaacgaaacaaacacaaauauuuaccacguacucggacaaucaaccgggaguauugauacaaguauacgaaggagaaagagcaaugacuaaagacaacaaucuauuaggaagauucgaauuaucaggaauaccgccagcaccaagaggaguaccacaaauagaaguaacauucgauauagacgcaaauggcauuuuaaacguaacagcaacagacaaaucaacagguaaagcaaacaaaauaacaauaacaaaugauaaaggaagacuaucuaaagaagaaauagaaagaaugguacaagaagccgaaaaauacaaagcagaagaugaaguucaaagagaacgugugagugccaagaaugcacuugaaucguaugcguucaauaugaaaagcgcaguagaagaugagggccuaaaaggaaaaauaucagaagcagacaaaaagaaagucuuggauaagugucaagaaguaauaaguugguuagaugcaaacacacucgcagaaaaagaugaauuugaacauaaaagaaaagaacuagaacaaguaugcaauccaauaauaucaggguuauaccaaggagcaggcggaccaggacccgggggauucggugcccagggaccaaaaggcgguaguggcagcggaccaaccauugaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6827 - RNA, 2202 nt, Artificial Sequence
  mRNA product Design5 comprising derived and/or modified sequence from Homo sapiens__NP_005518.3 __HsHSPA1L (opt6)
gggagagucccgcagucggcguccagcggcucugcuuguucgugugugugucguugcaggccuuauucaagcuuaccauggcuacagcaaaaggaauagcaauaggaauagauuuaggaacaacauauucguguguuggaguauuccaacacggaaaaguagaaaucauagcaaaugaccaaggaaacagaacaacaccaagcuauguagcauuuacggauacagaaagauuaauaggagacgcagccaaaaaccaaguagcuaugaauccacaaaauacaguauucgaugcaaaaagacuaauaggaagaaaauuuaaugacccaguaguacaagcagauaugaagcuauggcccuuccaaguuauaaaugaaggagggaaaccaaaaguucuaguaaguuauaaaggugaaaauaaagccuucuauccagaagaaauaucaagcaugguccuaacaaaacuaaaagaaaccgcagaagcauucuuaggacauccugucacuaacgcaguaauaacaguaccagcauacuucaacgauagucaacgucaagcaacaaaagaugcuggaguuauagcaggacuaaauguacuacgaauaaucaacgaaccgacagcagcagcuauagcauauggacucgacaaaggcggacaaggagaaagacacgugcucaucuucgacuuaggcgguggcacauuugauguauccauacuaaccauugacgauggaauuuucgaaguaaaagccacagccggagacacccaucuagggggagaagauuucgauaaccgguuaguaagucacuucguagaagaauuuaaaagaaaacacaagaaagauauaagucaaaauaaacgagcaguaagaagauuaagaacagcaugugaaagagccaaaagaacacuuaguaguucaacacaagcaaacuuagaaauagauucauuauacgaaggaauagauuucuauaccaguauaacaagagcaagauuugaagaacuaugcgcugauuuauuucgcggaacauuagaacccgucgaaaaagcauuaagagaugcaaaaauggauaaagcaaaaauacacgacauaguauuagugggagguagcacgcgaauaccaaagguucaacgauuauuacaagacuauuuuaauggcagagaccucaauaaaaguauaaacccugaugaagcaguugcauacggagcugcaguacaagcagcuauacugaugggagacaaaucagaaaaaguacaagaucuccuacuacuagacguagcuccacuaucacugggucuugagacagcgggaggcguaaugacagcauuaauuaaaaggaacucgaccauacccacaaaacaaacacaaauauuuaccacauauucagauaaccaaccuggagugcuuauucaaguauacgaaggagaaagagcaaugacgaaagauaauaacuugcuaggaagauuugaucuaacagggauuccaccagcaccaagaggcgugccacaaauagaagucaccuucgacauagacgcaaacggaauauuaaacgucacagcaaccgauaaaucaacagguaaggucaauaaaauuacaauaacaaacgauaaaggaagacuaucaaaagaagaaauagaaagaaugguacuagaugcagaaaaauacaaagcagaagacgaaguacaaagagagaaaauagcagcuaaaaacgcgcuagaaaguuacgcauuuaacaugaaaaguguaguaucugaugaaggauuaaaaggcaaaauuucagaaagcgauaaaaauaaaauacuagacaaaugcaaugaacuacuuaguugguuagaaguaaaucaacuagccgaaaaggaugaauuugaccauaaaagaaaagaacuggaacaaauguguaaucccaucauaacaaaacuauaucaaggaggcugcacaggaccagcauguggaaccggauauguaccaggacguccagcaacaggaccaacaauagaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6828 - RNA, 2196 nt, Artificial Sequence
  mRNA product Design5 comprising derived and/or modified sequence from Homo sapiens__NP_068814.2 __HsHSPA2 (opt6)
gggagagucccgcagucggcguccagcggcucugcuuguucgugugugugucguugcaggccuuauucaagcuuaccaugucagcaagaggaccagcaauugggauagaucuaggcacaacuuacucaugcguagguguauuccaacacggaaaaguagaaauuauagcaaacgaucaagggaacagaacaacaccaaguuauguagcauuuacagacacugaaagauuaauaggugacgcagcuaaaaaucaaguagcaaugaacccuacaaacacaauuuuugacgcaaaacgacuaaucggaagaaaauucgaagacgcaacaguacaaucagauaugaaacauuggccguucagaguaguaagcgaaggagggaaaccaaaaguacagguugaauacaaaggagaaacaaaaacuuucuucccagaagaaauuaguaguaugguccucacaaaaaugaaagaaauagcagaagcauaccuuggaggaaaaguucacucagcaguaauuacaguaccagcauacuucaacgauucccaaagacaagcaacgaaagacgccgguacaauaacaggauuaaacguguuaagaauuauaaacgaaccuaccgcagcagccauagcguauggauuagauaagaaaggaugugcaggaggagagaaaaauguauuaauauuugacuuaggcggugggacauuugauguaaguauacugacaauagaagaugggauauuugaagucaaaucgacagcaggagacacacauuuagggggagaagacuuugacaacagaaugguaagccaucuagcagaagaguucaaaagaaaacacaagaaagacauaggacccaauaaaagagcugucaggagacuuagaacagcaugcgaaagagcaaaaagaacauuaucaaguucaacacaagcaaguauagaaauagauucgcuauaugaaggaguugauuucuauacaaguauaacaagagcaagauuugaagaacuaaacgccgaucuauuuagaggaacauuagaaccgguugaaaaagcacuuagagacgcaaaauuggauaaaggccaaauacaagaaauuguucuaguaggaggaaguacacgcauuccaaaaauacaaaaacuauuacaagacuuuuucaauggaaaagaacucaauaaaucaauaaacccugaugaagcgguagcguauggugcagccguacaagccgcaauauuaaucggagacaaaagugaaaacguacaagaccuacuauuguuagauguaacaccauuaucacucggaauugaaacagcuggaggaguaaugacaccacucauaaaaagaaauacaaccauucccacaaaacaaacacaaacauucacaacguacagcgauaaccaaaguagcguccuaguacaaguauaugaaggcgaaagagcaaugaccaaagacaacaaucuauuaggaaaauucgacuuaacaggaauaccuccagcaccaaggggaguaccacaaauagaaguuacauuugacauagaugcuaacggaauauuaaacguaacagcagcagauaaaagcacaggaaaagagaauaaaauaacaauuacaaacgauaaaggaagacuaagcaaagacgauauagauagaaugguacaagaagcagaaagauauaaaagcgaagacgaagcuaacagggaucgagucgcagccaaaaaugcauuggaaagcuauacauacaauauaaaacaaacuguagaagaugaaaaauuaagaggaaagauaagugaacaagauaaaaauaaaauuuuagacaaaugucaagaaguuauaaacugguuagauagaaaccaaauggccgaaaaagacgaguacgaacauaaacaaaaagaacuagaaagagucuguaaucccauaauuagcaaauuauaccaaggaggacccggagguggaaguggaggaggaggaucaggagcaagcggaggcccaacaauagaagagguugauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6829 - RNA, 2799 nt, Artificial Sequence
  mRNA product Design5 comprising derived and/or modified sequence from Homo sapiens__NP_002145.3 __HsHSPA4 (opt6)
gggagagucccgcagucggcguccagcggcucugcuuguucgugugugugucguugcaggccuuauucaagcuuaccaugagcgugguagguauagaucuuggauuccaaucauguuacguugccguagcaagagcaggaggaauagaaacaauagccaacgaauacagugacagauguacaccggccugcauauccuuuggaccuaaaaacagaucaaucggcgcagccgcaaaaucacaagugauuucaaaugcuaaaaacacagugcaagguuucaaaagauuccacggacgagcauuuagcgacccauuuguugaagcagaaaaaucaaacuuagcuuaugauaucguacaauuacccacaggacuaacagguauaaaagucacauauauggaagaggaaagaaacuucacaaccgaacaaguaaccgcgaugcuauuaucaaaacucaaagaaacagcagaauccgucuuaaagaaaccugucguugacuguguaguaucaguacccugcuucuacacagacgcagaaagaagauccguaauggaugccacacaaauagcuggucugaauugcuuacgacuaaugaaugaaacgacggcaguugcauuagcuuacggaauauauaaacaagacuuacccgcacuagaagaaaaaccaagaaacgucguauuuguagauaugggucacagugcauaucaaguguccguaugugcuuuuaacagagguaaacuaaaaguauuagcaacagcuuuugauacuacuuuaggcggacgaaaauuugaugaaguucuaguaaaucauuuuugcgaagaauuugguaagaaauacaaacucgauaucaaaucaaaaauacgugcauuauuacgacuuucacaagaaugugaaaaacuaaagaaauuaaugagugcaaacgcaagcgaccugccuuuaucuauagaauguuucaugaacgauguagauguaucgggcacaaugaacagagguaaauuccucgaaaugugcaacgaucuguuagcaagaguagaaccaccacuacgaaguguauuagaacaaacaaaacuaaagaaagaagacauuuaugcaguagaaauaguuggaggggcaacacgaauaccagcgguaaaagagaaaauuucaaaauucuuuggcaaagaauuaucaacuacacuuaaugcagaugaagccguaacuagaggaugugcacuccaaugugcaauauuaucaccagcuuucaaaguaagagaauuuagcauaacagauguaguaccauacccaauuucacugagauggaacucaccagcagaagaagggucauccgacugcgaaguauucaguaaaaaucaugcugccccuuuuucaaaaguacuaacauucuauagaaaagaaccuuuuacccuagaagcauacuauucaucaccccaagaucuuccauaccccgauccagcaauagcccaauuuagcgugcaaaaaguuacaccucaaagugauggaucaagcaguaaaguuaaaguaaaaguccgugugaacguucaugguauauuuaguguaucuucagccagccuaguagaaguacacaaaagcgaagaaaaugaagaaccaauggaaacggaucaaaaugcuaaagaagaagagaaaaugcaaguagaccaagaagaaccacauguagaggaacaacaacaacaaacacccgcagaaaacaaagccgaaagugaagaaauggaaacaucucaagcaggaucaaaggauaagaaaauggaucaaccuccucaagcgaagaaagcaaaaguaaaaacaucuacagucgaucuuccaauagaaaaccaacuuuuauggcaaaucgauagagaaauguuaaaccuauauauagaaaacgaaggaaaaaugauaaugcaagacaaauuagaaaaagaaagaaacgacgcuaaaaacgcaguagaagaauauguuuaugaaaugagagauaaacugagcggagaauacgaaaaauucguaagcgaagacgaucgaaauucauucacccuaaaacuugaagacacugaaaacuggcucuacgaagauggagaagaccaaccaaaacaaguauacguagauaaacuagcagaacugaaaaaccuaggacaaccaauaaaaauaagauuccaagaaagugaagaacguccuaaauuauucgaagaacuaggaaaacaaauacaacaauauaugaaaaucauaucaaguuuuaaaaacaaagaagaucaauacgaccacuuagaugccgcagacaugacaaaaguagaaaaaucuacuaacgaagccauggaauggaugaauaauaaauuaaaccuccagaacaaacaaucgcuaacaauggauccaguggucaaaucaaaagaaauagaagcaaaaauuaaagaacuaacaaguacuugcucaccaaucauaagcaaaccaaaacccaaagucgaaccaccaaaagaagaacagaaaaacgcagaacaaaauggaccaguagacggccaaggugacaacccaggaccacaagcagcggaacaagguacugacacagcaguacccucagacagugauaagaaacuaccagaaauggauauagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6830 - RNA, 2796 nt, Artificial Sequence
  mRNA product Design5 comprising derived and/or modified sequence from Homo sapiens__NP_055093.2 __HsHSPA4L (opt6)
gggagagucccgcagucggcguccagcggcucugcuuguucgugugugugucguugcaggccuuauucaagcuuaccaugucaguagucggaauugaccuuggauuuuuaaacugcuacauagcaguagcuaggucaggaggaaucgaaacaauagcaaacgaauauagcgauagaugcaccccugccugcauaucauuaggaucacgcacuagagcaaucgggaacgcagccaaaucacaaauaguuacaaacguaagaaauacaauccacggauucaaaaaacuacacggcagguccuuugaugauccaauaguacaaacggaaagaauaagacuacccuacgaacugcaaaaaaugcccaauggaagugcaggcgucaaagucagauaucuagaagaagaaagaccuuuugcaauagaacaaguaaccggaauguuauuggcuaagcuaaaagaaacuucagaaaacgcauuaaagaaaccuguagcagauuguguuauaucaauaccaucguuuuucacagaugcagaacgaagaucaguaauggcagcagcacaaguagccggccuaaacugucuucgacuaaugaaugaaacaacugcaguugcccuagcuuauggaauuuauaaacaagauuuaccuccucuagacgaaaaacccaggaacguaguauucauagauaugggucauagugcauaucaaguucuagugugugcauuuaauaaaggaaaauuaaaaguccuagcaacaacauucgauccguaucuaggagggcgaaacuucgaugaggcacugguagacuacuuuugugacgaauucaaaacgaaauacaagauuaacguaaaagaaaacagcagagcucuucuaaggcuauaccaagaaugugaaaaacucaaaaaauuaauguccgcuaaugccucagaccuaccacuaaauauagaauguuucaugaaugauuuagaugugucaaguaaaaugaacagagcacaauuugaacaauuaugcgcaucauuacuagcucgaguagaaccaccauuaaaagccguaauggaacaagcuaauuuacaacgagaagauaucucaucaauagaaaucguuggaggagccaccagaauuccagcgguaaaagaacaaauuacuaaauuuuuucuuaaagacaucucaacaacacuaaaugcugacgaagcaguugcccggggaugcgcccuccaaugugcaauacuuagcccugcauuuaaaguacgagaauuuucaauaacagacuuaguuccauauucgaucacauuaagauggaaaacaucauucgaagacggcagcggcgaaugugaaguauucugcaaaaaccacccagccccuuuuagcaaaguaauaacauuucauaaaaaagaaccguuugaauuagaagcauuuuacacaaacuuacacgaaguaccauacccugaugcacgaauagguagcuuuacuauacaaaacguauucccacaauccgauggcgacagcucaaaaguuaaaguaaaagucagaguaaacauacauggaauuuucucugucgcaucagcaucuguuaucgaaaaacaaaaucuagaaggggaccauuccgacgccccaauggaaaccgaaacaagcuuuaaaaaugaaaacaaagacaauauggauaaaaugcaaguagaucaagaagaaggacaucaaaaaugccaugcugagcauacaccagaagaagagauagaccacacuggggcaaaaacaaaaucagccguuucagauaaacaagauagauuaaaucaaacacuaaaaaaaggcaagguaaaaucuauugauuuaccaauccaauccucacucugcagacaauuaggacaagaucuauuaaauagcuauauagaaaaugaaggaaaaaugaucaugcaagacaaacuagaaaaagaaagaaacgacgccaaaaaugcaguugaagaauacguauaugauuucagggaccgacuaggaaccguuuaugaaaaauuuauaacgccagaagaccuuucaaaacuaagugcaguauuagaagacacagagaacugguuauaugaagauggagaagaccaaccaaaacaaguauacguugacaaauuacaagaacuaaagaaauacggacaaccaauacaaaugaaauacauggagcacgaagaacguccaaaagcacuaaacgaccuaggcaaaaagauccaacuuguaaugaaaguaauagaagcuuauagaaauaaagaugaacgguaugaccaucuugaccccacagaaauggaaaaaguugaaaaaugcauaagcgacgcaaugagcuggcucaacagcaaaaugaacgcacaaaacaaauuaucacuaacacaagauccaguaguaaaagucagugaaauaguagcaaaaucaaaagaacuagacaauuucuguaauccaauaauauacaaacccaaaccaaaagccgaaguccccgaagacaaaccaaaagcaaacucagaacauaaugguccaauggauggacaaucuggaacagagacaaaaucagacucaacuaaagauucaucccaacauaccaagaguagcggggaaauggaagucgacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6831 - RNA, 2241 nt, Artificial Sequence
  mRNA product Design5 comprising derived and/or modified sequence from Homo sapiens__NP_005338.1__HsHSPA5 (opt6)
gggagagucccgcagucggcguccagcggcucugcuuguucgugugugugucguugcaggccuuauucaagcuuaccaugaaauuaaguuugguggcagcaaugcuauuauuauuaagcgcugcaagagcagaagaagaggauaaaaaagaagauguugguacggugguuggaauugaccuuggaacaacauacagcugugucggaguauuuaaaaauggaagaguugaaauuauagcuaacgaucaggggaauagaauaacaccaaguuacguagcauucacaccagagggagaaagauuaaucggagacgcagcaaaaaaccaacuuacuaguaauccagaaaauacaguauucgaugcaaaaagauuaauaggaagaacauggaacgacccuuccguacaacaagauaucaaauuccuaccauuuaaaguuguagaaaaaaagacaaaaccauacauacaagucgauauaggaggaggacaaacaaaaacauuugcgccagaggaaaucagugcaaugguauuaacuaaaaugaaagagacagcagaagcauacuuagguaaaaaaguaacacacgcaguagucacaguaccagcauauuuuaacgacgcacaaagacaagcaacaaaggaugcaggaacaaucgcaggauuaaacguaaugagaauaauaaaugagccaacagcagcagcaauugcauauggauuagacaaacgagaaggugagaaaaacauccugguauucgacuuaggagggggcacauuugacguaaguuuauuaacuauagauaauggaguauuugaaguaguagcaacaaacggugacacacauuuaggaggagaagauuucgaucagagaguaauggaacauuuuauaaaauuauacaaaaaaaaaacaggaaaagauguaaggaaagacaauagagcagugcaaaaacuuaggagagaagucgaaaaagcaaaacgagcccuaaguagccaacaucaagcaagaauagaaauagaaagcuuuuaugaaggggaagacuucagugaaacacuuacgagagcaaaauuugaagaauuaaacauggaccuauuuagaagcacaaugaaaccuguacaaaaagugcucgaagauucagaccuaaaaaaaagcgacauagaugagauugucuuaguaggaggaaguacaagaauuccaaaaauccaacaacuaguaaaagaauuuuucaauggaaaagaaccuaguagaggaauaaacccagacgaagcaguagcauauggagcugcaguacaagcuggaguucuaaguggcgaccaagacacaggagacuuaguauuacuagacguauguccguuaacauuaggaauagaaacaguaggaggaguaaugaccaaauugauaccuaggaacacuguuguaccaacgaaaaaaucacaaauauuuaguacagcaucagauaaccaaccaacuguaacuauaaaaguauacgaaggagaaaggccucuaacaaaagacaaucaccuucugggaaccuuugaucucacaggaauaccaccagcaccacggggaguaccgcaaauagaaguaacauucgaaauagacgucaacgguauucuaagaguaacggccgaagauaaaggaacaggaaacaagaauaagauaacuauuacaaaugaccaaaaucgauuaacuccagaagaaauagaacgaauggucaacgacgcagaaaaauuugccgaagaagauaaaaaauuaaaagagagaauagauacucgaaacgaacuagaaaguuacgccuacucacucaaaaaccaaaucggggauaaagaaaaguuaggagguaaauuaucaagugaagauaaagaaacaauggaaaaagcagucgaagaaaaaauugaauggcuagaaucacaccaagacgcagauauagaagauuucaaagcaaaaaaaaaagaauuagaagaaauuguacaacccauaauuaguaaauuauauggaagugcagggccaccaccaacaggcgaagaagacacagcagaaaaagaugaauuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6832 - RNA, 2208 nt, Artificial Sequence
  mRNA product Design5 comprising derived and/or modified sequence from Homo sapiens__NP_002146.2__HsHSPA6 (opt6)
gggagagucccgcagucggcguccagcggcucugcuuguucgugugugugucguugcaggccuuauucaagcuuaccaugcaagcaccaagagaacuagcgguaggaauagauuuaggaacaacuuacucauguguaggaguauuucaacaaggaagaguagaaauauuagcaaaugaccaaggaaauagaacaacacccucauacguagccuuuacagacaccgaacgauuaguaggagaugcagcaaaaagccaagcagcacucaacccacauaauacggucuuugacgcaaaaagauuaauaggccgaaaauuugcggauacuacaguacaaagugauaugaaacacuggcccuuucgaguaguaucugaaggaggaaaaccgaagguaagaguauguuaucgaggagaagacaaaacauucuauccagaagaaauaucuucuaugguauugucgaaaaugaaagaaacggcugaagcguaucuaggacaaccaguaaaacaugcaguaauaacuguaccagcuuacuuuaaugauagccagagacaagcaacaaaagaugcaggagccauagcaggauuaaauguauugaggauaauaaaugaaccaacugcagccgcaauagcauacggguuagaccgaagaggagccggugaaagaaaugucuuaauauuugauuugggcggaggaacauuugauguaaguguauuaucaauagacgcaggaguuuuugaagucaaagcaacggcaggagacacacauuuaggaggggaagacuuugauaauaggcuaguaaaucauuucauggaagaauuucgaagaaaacacggaaaagauuuaucuggaaauaaacgagcuuuaagaagguuaagaacagccugugaaagagcaaaaagaacauuaucaucaaguacacaagcaacauuagaaauugacucacucuucgaaggagucgacuucuauacaucaauaacacgagcaagauuugaagaacuaugcucagaucuauuucgaucaacauuagaaccaguggaaaaagcauugcgggaugcgaaauuagacaaagcacaaauacaugacguaguuuuaguaggcggcucaacaagaauaccaaaagugcaaaaacuauuacaagauuucuucaacgggaaagaauuaaacaaaucaauuaauccggaugaagcuguagcuuauggagcagcaguucaagccgccgucuuaaugggagacaaaugcgaaaaaguucaagauuuauuacuacuagauguggcaccacucucucuuggucucgaaacagcgggaggaguuaugacuacguuaauccaaagaaaugcaacaauuccaacaaaacaaacccagacauucacaacauacucugauaaucaaccaggagucuuuauacaaguuuacgaaggcgaacgagcaaugacaaaagauaauaauuuauugggaagauuugaacuuucaggaauacccccagcaccuagaggaguaccucaaauagaaguaaccuucgacauagacgcuaauggaauacuuagcguaacugcaacugauagaaguacaggaaaagcaaacaaaauaacaauaacaaacgauaaaggccgacuaagcaaagaagaaguagaaagaaugguacaugaagcugaacaauacaaagccgaagaugaagcacaacgagauagaguugcagcuaaaaauagucuagaggcacauguauuucauguaaaaggcagccuacaagaagagagcuuaagagacaaaauaccagaagaagacagaagaaaaaugcaagauaaguguagagaaguauuggcaugguuagaacauaaucaauuagcagaaaaagaagaauaugaacaucaaaaacgagaauuagaacaaauaugucgaccaauauuuucaagguuauauggaggcccaggaguaccagggggaaguucaugugguacacaagcaagacaaggugauccgucaacaggaccaaucaucgaagaaguagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6833 - RNA, 1380 nt, Artificial Sequence
  mRNA product Design5 comprising derived and/or modified sequence from Homo sapiens__P48741__HsHSPA7 (opt6)
gggagagucccgcagucggcguccagcggcucugcuuguucgugugugugucguugcaggccuuauucaagcuuaccaugcaagcaccaagagaauuagcuguaggaauagacuuaggaacaacauauuccuguguaggaguauuucaacaaggaagaguagaaauuuuagcaaaugaucaaggaaauagaacaacaccaucauauguagcauuuacugauaccgaaagauuagucggagaugcagcaaagucacaagcagcauuaaauccucacaauacaguuuuugaugcaaaaagauuaauaggaagaaaauucgcugauacaacaguacaaagcgacaugaaacauuggccauuccaaguuguaagcgaagguggaaaaccaaaaguacgaguauguuauagaggagaagacaaaacauucuaccccgaagaaauaucaaguaugguucuaucaaaaaugaaagaaacagcagaagcauauuuaggacaaccaguuaaacaugcaguaauaaccguuccaacauauuuuagcaauagucaaagacaagcaacuaaagaugcaggagcaauagcaggacuuaaaguacugccaauaauaaaugaagcaacagcagcagcaauagccuauggccuagacagaagaggagcuggaaaaagaaacguauuaauauuugauuuaggaggaggaacuuuugauguaaguguauuaaguauugacgcaggcguuuuugaaguaaaagcaacugcuggugauacucacuuggguggagaagauuuugauaauagauuaguaaaucauuuuauggaagaauuuagaagaaaacacggaaaagaucuaaguggaaauaaaagggcauugagaagauuaagaacagcaugugaaagagcaaaaagaacaccuagcucaaguacacaagcaacgcuagaaauagauucauuauucgaaggaguagauuuuuauaaaucaaucacaagggcaagauuugaagaauuaugcagugacuuauucaggagcacauuagaaccaguagaaaaagcauuaagagaugcaaaauuagauaaagcacaaauacaugauuuugugcuaggagggggauuacauucacauccacaaggagcagaaguugcagcaggauuauuacaaagacaaggagcagaacaagaacaccaaccauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6834 - RNA, 2217 nt, Artificial Sequence
  mRNA product Design5 comprising derived and/or modified sequence from Homo sapiens__NP_006588.1 __HsHSPA8 (opt6)
gggagagucccgcagucggcguccagcggcucugcuuguucgugugugugucguugcaggccuuauucaagcuuaccaugagcaaagggccagcaguaggaauagauuuagguaccaccuacagcuguguaggaguauuccaacacggaaaaguggaaauaauagcaaaugaccaaggcaauaggacaacaccaucauacguugcauucacagauaccgagcgacuaauuggagaugcagcuaaaaaucaaguagcaaugaauccaacaaauacgguauuugacgcaaaaagacuaauaggcaggagguuugaugacgcaguuguacaaagcgauaugaaacacuggccauuuaugguaguaaaugaugcuggaagaccaaaaguacaaguagaauacaaaggcgaaacuaaaaguuucuaccccgaagaaguaucuucaaugguauuaacaaaaaugaaagaaaucgcagaagcauacuuaggaaaaacgguuacaaacgcaguaguaacaguaccagcauauuuuaacgacucccaaaggcaagcaacaaaagacgcugggacaauugccgggcuuaauguauuaagaaucauaaaugaaccaacagcagcagcaauagccuacggauuagauaagaaaguaggugcagaaagaaacguauuaauauuugacuuaggcgguggaacauuugauguaucaauauuaacaauagaagacggaauauuugaaguaaaaucuacagcuggagacacacaccuaggaggagaagauuucgauaacagaaugguaaaucauuuuauagccgaauuuaaaaggaaacauaagaaagauauaagugaaaauaaaagagcaguaagaagauuaagaacagcaugcgagcgagcgaaaaggacuuuaucaucgagcacacaagcaagcauagaaauugauagccuauaugaagguauagacuuuuacacaucaauaacaagagcccgauucgaagaauuaaacgcagaucuauuuagaggaacguuagacccaguagaaaaagcauuaagagaugcaaaauuagauaaaagccaaauacaugacaucguauugguuggaggaucuacaagaauaccuaaaauacaaaaauuacuacaagacuucuuuaacggcaaagaauuaaacaaaucaauaaauccagacgaagcaguagcguauggugcggcgguacaagccgcuauauuauccggagacaaaagugaaaacguacaagaucuacuauuacuagacguaacaccccuaucauuaggaauugaaacagcaggaggaguaaugacaguuuuaauaaaaagaaauacaacaauaccaacuaaacaaacccaaacauuuacaacuuacagugacaaucaaccaggagugcucauacaaguuuacgaaggagaacgagcaaugacaaaagacaacaaucuauuaggaaaauuugaacuaaccggaauaccaccagcaccuagaggcgugccacaaauagaagucacauuugacauagaugcaaauggaauacuaaacgucagcgcagucgauaaaucaacaggaaaagaaaacaaaauaaccauaacaaacgacaaaggacgccugagcaaagaagauaucgaacgaaugguacaagaagcagaaaaauauaaagcggaggacgaaaaacaacgagacaaaguaagcaguaaaaacagcuuagaaucauaugcauuuaauaugaaagcaacuguagaagacgaaaaauuacaaggaaaaauaaacgaugaagauaaacagaaaauacuagacaaauguaacgagauaauaaauuggcuggacaaaaaucaaacggcagaaaaagaagaauuugaacaucaacaaaaagagcuugaaaaaguuuguaauccaauaauaacaaaacuauaucaaagugcaggaggaaugccaggaggaaugcccggaggauucccuggaggaggcgcacccccaaguggaggagccaguucaggcccaacaauagaagaaguagauuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6835 - RNA, 2316 nt, Artificial Sequence
  mRNA product Design5 comprising derived and/or modified sequence from Homo sapiens__NP_004125.3 __HsHSPA9 (opt6)
gggagagucccgcagucggcguccagcggcucugcuuguucgugugugugucguugcaggccuuauucaagcuuaccaugauaucagcaagcagagcagcagcagcaagacuugugggagcagcagcaucaagaggaccuacagcagcaaggcaucaagauucguggaauggguuaagccaugaggcguuuagacuugugucuaggagagauuacgccagcgaagcaauuaaaggugcgguuguaggaauagaucuaggaacgacaaacucauguguagcagucauggaaggaaaacaagcaaaagugcuagaaaaugcagaaggcgcaagaacaacaccaucaguaguugcauuuacagcagauggagaaagguuaguugguaugccagcaaaaagacaagcaguaacaaauccgaacaauacauuuuacgcuacaaaaagguuaauaggaagaagauacgaugacccagaagugcaaaaagauauuaaaaauguaccuuuuaaaauagucagagcaucuaauggugaugcauggguagaggcccacggaaaacucuacucuccaagucaaauaggagccuucguauuaaugaagaugaaagaaacagcugaaaauuauuuaggacacacagcgaaaaaugcaguaauaacgguaccagcauacuucaacgacagucaaagacaggcaacaaaagacgcaggacaaauaaguggauuaaacguauuaagaguaauaaaugaaccuacagcagcagcauuagcauauggccuagauaaaucagaagacaaaguaauagcgguauaugauuuaggcggaggaacauuugacauuucaauauuagagauacaaaaagguguauuugaaguuaaaaguacaaauggugacacauuuuugggaggagaagauuucgaucaagcacuacuucgacauauaguuaaagaguuuaaaagagaaacagggguagaucucacuaaagauaauauggcauugcaaaggguaagggaagcagcugaaaaagcaaagugcgagcuaagcucaucuguacaaacggauauuaaucuaccauauuuaacaauggacagcucagguccaaaacaucucaauaugaaauuaacaagagcucaauucgaaggaauaguaacggacuuaauaagaagaacuauagcaccaugucaaaaagcuaugcaggaugcggaagugagcaagagugacauaggagaaguuaucuugguagguggaaugacaagaaugccaaaaguucaacagacaguacaagaucuauucgggagagcuccuaguaaagcuguuaauccagacgaagccguagccauaggagcagcaauacaaggaggaguauuagcaggagauguaacugauguacuacuauuagauguaacaccguugagccuuggaauagaaacuuuaggaggaguguucacuaaauuaaucaauagaaauacaacgauaccuacgaagaaaucacaaguauucaguacagcagccgaugggcaaacacaaguagaaauaaaagucugccaaggagaaagagagauggcaggagauaauaaauuguuagggcaauuuacauuaauagguauaccuccagcaccgagaggaguaccucagauagaaguuacauucgauauagaugcaaaugguauaguucauguaucagcaaaagacaaaggaacuggaagagaacaacaaauagugauacaaagcaguggaggacuaaguaaagaugauauagaaaacaugguuaaaaacgcggaaaaauaugcagaagaagauagaagaaagaaagagagaguagaagcaguuaacauggcugaaggaauaauacaugacacugaaacaaaaauggaagaauuuaaagaucagcuaccagcagaugaauguaauaaacuaaaagaggaaauaaguaaaaugagagaauuguuagcuagaaaagacagugagacuggagaaaauauuagacaagcagcaagcucauuacaacaagcaagccucaaauuauuugagauggcauauaagaaaauggcaucagaaagggaaggauccggaucaagcggaacgggagaacaaaaagaagaucaaaaagaagaaaaacaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6836 - RNA, 2304 nt, Artificial Sequence
  mRNA product Design5 comprising derived and/or modified sequence from Homo sapiens__NP_079291.2__HsHSPA12A (opt6)
gggagagucccgcagucggcguccagcggcucugcuuguucgugugugugucguugcaggccuuauucaagcuuaccauggcagacaaagaagcaggcggaagugaugggccaagagaaacagcaccaacaucagcauacaguucaccagcaagaagccuaggagacacaggaauaaccccauuaaguccaucgcacauuguaaacgacacagacuccaacguaagcgaacaacaaaguuuccuaguaguaguagcuguagauuuuggaaccacaucaucaggauacgcauacucauuuacaaaagaaccugaauguauacaugucaugagaagaugggaaggcggagauccuggaguaaguaaucaaaaaacuccaacaacaauacuucucacaccagaacgaaaauuccacucauuuggauaugcagccagagacuuuuaccacgauuuagauccaaaugaagcaaaacaaugguuauaccuagaaaaauucaaaaugaaacuucauaccacuggagauuuaacaauggacacagaccuaacagcagccaauggaaaaaaaguaaaagcacuagagauauuugcauacgcacuacaauacuuuaaagaacaagcacuaaaagaauuaagcgaccaagcagguuccgaauuugaaaauucagacguaagauggguaauaacaguccccgcaauauggaaacaacccgccaagcaauuuaugagacaggcagcauaccaagcgggacuagccuccccagaaaacucagaacaacuaauuauagcacuugaaccagaggcagcgucaauauauuguagaaaacuacgauuacaucaaaugauagaauuaaguucaaaagcagcaguaaauggauacucaggaucagauacagugggagcaggauuuacacaagcuaaagaacauauuagaagaaacagacaaagcagaacauuucuuguagaaaacgucauaggagaaauaugguccgaacuagaagaaggagauaaauauguaguaguugacagcggaggaggaacaguagaucuaacuguccaucaaaucagacuacccgaagggcacuuaaaggaacuauacaaagcaacgggaggcccauacggcucauuaggaguugacuacgaauucgaaaaauuauuauacaaaauauucggagaagauuuuauagaacaauuuaaaaucaaaaggccugcagcauggguagauuuaaugauagcauuugaaagcagaaaaagagccgcagcacccgauagaacaaacccacuaaauauaacacuaccguucucauuuauagauuacuauaaaaaauuuagaggacauucgguagaacaugcacuaagaaaaagcaacguugacuuugucaaauggagcagucaaggaauguuacggaugagcccagaugcaaugaaugcacuauucaaaccaacaauagauaguaucauagaacauuuaagagauuuauuucaaaaaccagaagucaguacaguaaaauuccuauucuuaguaggcggauucgcagaagcaccccuauuacaacaagccguacaagcagcauucggagaucaauguagaauaauaaucccacaagaugucggacucacaauacucaaaggagcaguucuauucggacucgacccagcaguaauuaaaguaagaagaucaccacuuaccuaugguguugguguauuaaauagauauguagaaggaaaacacccuccagaaaaauuauuaguaaaagauggaacaagauggugcacugacguauuugauaaauuuauuucggcagaccaaucaguagcucuaggugaacuuguaaaacgauccuauacaccugcaaaaccaucacaacuagucauaguaauaaauauauacuccucagaacacgauaaugucucauuuaucacugacccaggaguaaaaaaauguggcacauuaagauuagauuugacagguacaagugguacugcaguacccgcacgaagagaaauccagacauuaaugcaauuuggcgacacagaaaucaaagccacagcaauagacauagccacaucuaaaucaguaaaaguaggaauagacuucuuaaauuauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6837 - RNA, 2337 nt, Artificial Sequence
  mRNA product Design5 comprising derived and/or modified sequence from Homo sapiens__NP_443202.3 __HsHSPA12B (opt6)
gggagagucccgcagucggcguccagcggcucugcuuguucgugugugugucguugcaggccuuauucaagcuuaccaugcuugcaguuccagaaaugggacuacaaggacuauauauaggcaguucaccagaacgaaguccgguacccaguccaccgggaucaccaaggacacaagaaaguugcggaauagcaccucuaacaccuagccaaucaccuaaaccugaagugagagcaccacaacaagcgaguuucucgguuguaguagcaauagauuucggaacaacaucaagugguuaugcauuuucauuugcuucagauccagaagcuauacauaugaugcgaaaaugggaaggaggcgauccuggcguagcacaucagaaaaccccuacuugucuauugcuaacaccagaaggagcauuucauaguuuuggauauaccgcucgagauuacuaucaugacuuagauccagaagaagcaagggauugguuauacuuugaaaaauuuaaaaugaaaauacauagugccacggaucuaacauuaaaaacacaauuagaagcaguaaauggaaaaacaaugccagcauuagaaguauuugcacacgcauugagauucuuucgcgaacaugccuuacaagaacuacgcgaacaauccccuuccuuaccagaaaaggauacuguacgauggguauuaacaguccccgcuauauggaaacaaccggcuaaacaauuuaugagagaagcagcauauuuggcuggccuagucagccgggaaaacgcugaacaauuacuaauagcauuagaaccagaagcugcaagcguauacuguagaaaacuaagacuucaucaauuacuagaucuaagcggaagggcaccuggaggagggcgauuaggagaaagaagaucuauagauucaucauuuagacaagcuagagaacaauuaagaagaucacgucacucaagaacauuucuaguugaaucagguguaggcgaacuuugggcagaaaugcaagcaggagacagauauguaguggcugacugcggaggggguacaguugaccuaacaguacaucaauuagaacaaccacacggaacacuaaaagaauuauauaaggcuucaggaggaccauacggggcaguaggaguugaucuagcuuuugaacaacuacuuugucgaauauucggugaagauuuuauagcaacauuuaaaaggcaaagaccugcugcauggguagaucuaacuauagcauucgaggcaagaaaacgaacagcaggaccacauagagcuggugcuuuaaacauuucauuaccauuuucauucauagauuuuuacagaaaacaaagaggacauaauguagaaacagcauuaagaagaaguucaguaaauuuuguaaaauggucuagucaaggaaugcuaagaaugucaugcgaagcuaugaacgaacuauuucaacccacaguauccgguauaauacaacauauagaagcacuauuagcuagaccugaaguacaaggaguaaaauuauuauuuuuaguaggaggauucgcagaaucagcuguguuacaacaugcugugcaagcagcguugggcgcuagaggucuaagaguaguaguuccucacgauguaggacuaacaauacuaaaaggagcaguauuauucggccaagcgccuggaguaguucgaguaagaagaucuccauuaacauauggugugggaguauuaaauagauucgugccagguagacauccaccagagaagcuauuaguaagagauggcaggaggugguguacugaugucuucgaaagguuuguugcagccgaacaaagcguugcacuaggagaagaaguuagaagaucauacuguccagcacggccaggacaaagaagagugcuaauuaacuuauauuguugcgcagcagaagaugcaagauuuauuacagacccagguguaagaaaguguggagcccucaguuuagaacuugaaccagcugauugcggccaagauacagcaggcgcacccccaggcagacgagaaauaagagcggcaaugcaauuuggagauacagaaauaaaaguuacagcuguagauguaagcacaaacagaaguguuagagcaucaauagacuuucuaaguaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6838 - RNA, 1692 nt, Artificial Sequence
  mRNA product Design5 comprising derived and/or modified sequence from Homo sapiens__NP_008879.3__HsHSPA13 (opt6)
gggagagucccgcagucggcguccagcggcucugcuuguucgugugugugucguugcaggccuuauucaagcuuaccauggcuagagaaaugacaauacucggcucugcaguauuaaccuuacuauuagcaggauauuuagcacaacaauaccuucccuuaccaacaccaaaaguaauagguauagaucucgguacaacauauuguuccgucggaguuuucuuuccaggaaccggaaaaguuaaaguuauaccagacgaaaauggacacauauccauaccaaguaugguaaguuuuaccgacaacgauguauaugucgguuacgaaagcguagaauuagcagauaguaauccacaaaacacaauauaugacgcaaaaagauucauaggaaaaaucuucaccgcagaagaacuggaagcagaaauaggaagauauccauucaaaguacuaaauaaaaauggaaugguagaauucucaguaacuuccaaugaaacaauaacaguaucaccagaauaugucggcucaagauuauuauuaaaauuaaaagaaauggcagaagcauacuuaggaaugccaguagcaaacgcaguaaucucaguaccagccgaauucgauuuaaaacaaagaaauuccacuauagaagcagcaaaucuagcaggucuuaaaauauuaagaguaauaaaugaacccacagcagcagcaauggcauauggacuacacaaagcagauguuuuucacguacuagugauagauuuaggaggcggcacauuagacguaagucuacucaauaaacaaggcgguauguuucuaacaagagccaugaguggaaacaacaaauuaggaggacaagacuuuaaccaaagacuacuacaauauuuauacaaacaaauuuaccaaacauauggauucgucccaucaagaaaagaggaaauccacagacuaaggcaagcaguagagauggucaaacuaaacuuaacauuacaucaaucagcacaacuaucagucuuauuaacaguagaagagcaagauagaaaagaaccucacuccagugacacagaacucccuaaagauaaacuaucaucagcagaugaccaccgagucaacaguggauucggaagaggccuaagugacaaaaaaagcggagaaucacaaguauuauuugaaacugaaauuagcagaaaacuauuugauacauuaaaugaagaccuauuucaaaaaauacuaguaccaauacaacaaguacucaaagaaggacauuuagaaaaaacagaaauagacgaaguaguacuaguaggaggaagcacacgaauuccuagaauaagacaaguaauacaagaauuuuucggcaaagacccuaauacaucaguagacccagaucuagccgucguaacaggaguagcaauacaggcaggaauagauggaggaagcuggccacuucaagucagugccuuagaaaucccaaacaaacauuuacaaaaaaccaauuucaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6839 - RNA, 1806 nt, Artificial Sequence
  mRNA product Design5 comprising derived and/or modified sequence from Homo sapiens__NP_057383.2__HsHSPA14 (opt6)
gggagagucccgcagucggcguccagcggcucugcuuguucgugugugugucguugcaggccuuauucaagcuuaccauggcagcaauaggaguacaccuaggauguacaucagcauguguagccguauauaaagaugguagagcaggaguuguggccaaugaugccggagauagaguaacuccugcaguaguugcauacagcgaaaaugaagagauaguuggacuagcugcaaaacaaagcagaauaagaaauauaaguaauacaguaaugaaagucaaacaaauauuaggaagaucaaguucagacccucaagcucaaaaauacauugcugaaagcaaaugucuaguaauagagaaaaauggaaaacuaagauaugaaauugauacgggugaagaaacuaaauucguaaacccagaagauguagcaagacuaauauuuaguaaaaugaaagaaacagcucauucaguauuaggaucagacgcaaaugacguaguaauaacuguaccauucgauuuuggagaaaaacaaaagaacgcuuuaggagaagcggcuagagcagcagguuuuaauguauuaagacuaauacaugaaccauccgcugcacuauuagcauacggaauaggacaagauaguccaacagguaaaucaaauauccuaguauucaaauuaggaggaacaucauuaucguuaucaguaauggaaguaaauagugggauauauagaguauugagcacaaauacagaugauaauauaggcggagcacauuuuacagaaacucuagcacaauaucuagcaagugaauuucaaagaaguuuuaaacaugauguucgaggaaaugcaagagcaaugaugaaauuaacaaauucagcggaaguagcaaaacacucauuaagcacguuagguagugcaaauuguuucuuagauaguuuauaugaaggacaagauuuugauuguaauguaucacgagcccgauuugaauuauuauguagcccucuauuuaauaaauguauagaagcaauaaggggauuacucgaucaaaauggauucacagcugaugauauaaauaaaguaguauuauguggagguucaaguagaauaccuaaauuacaacaacuaauaaaagacuuauuuccagcaguagaacugcuaaauaguauaccgccagacgaaguaauaccaauaggagcagcaauugaagccggaauacuaauuggaaaagaaaaucuauuaguagaagacagccuuaugauagaauguagugcaagagacauacucgucaaaggcguagaugaauccggagcaaguagauucacuguauuauucccaucaggaacgccacuaccagcaagaagacaacauacacuacaagcaccaggaagcauaucaaguguaugucuagaacuauaugaaucagacgggaaaaauagcgcaaaagaagaaacaaaauuugcacaaguaguauuacaagauuuagacaagaaagaaaauggauuaagagauauauuagcaguauuaacuaugaaacgagacggaagucuacauguaacauguacagaucaagagacaggaaaaugugaagcgauaucaauagaaauugcuagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6840 - RNA, 2853 nt, Artificial Sequence
  mRNA product Design5 comprising derived and/or modified sequence from Homo sapiens__NP_006635.2 __HsHSPH1 (opt6)
gggagagucccgcagucggcguccagcggcucugcuuguucgugugugugucguugcaggccuuauucaagcuuaccaugucaguaguaggacuugauguaggaucacaaucauguuauauagcaguagcacgagcaggagguauagaaacaauagcaaaugaauucagcgauagauguacaccuucagucauaucuuucggaucaaagaaucgaaccauuggcguagccgcaaaaaaccaacaaaucacgcacgcuaacaauacaguaucaaacuuuaaaagauuucacggucgagcguuuaaugaccccuucauucaaaaagaaaaagaaaacuuaagcuaugaccuuguaccacuuaaaaauggaggaguaggcauuaaaguaauguacaugggagaagaacaccuauuuaguguagaacaaaucaccgcgaugcuacuaacaaaacuaaaagaaacagcagagaauagccuaaaaaaaccaguuacugacugcguaauaaguguaccaucuuucuuuaccgacgcagaaagacgguccguucuagaugcagcccaaauaguaggauuaaacugucucagacuaaugaaugauaugacugcaguggcucuaaauuauggaauauauaaacaagacuugccaucacuagaugaaaaaccaagaaucguagucuucgucgauaugggccauagcgcauuucaaguuucagcaugugcuuucaacaaaggaaaacugaaaguucuaggaacggcauucgauccauuucuagggggaaaaaauuuugacgaaaaauuaguagaacacuuuugcgccgaauucaaaacaaaauacaaacuagacgcaaaaaguaaaauaagagcauuauugagauuauaccaagaaugcgaaaaacuaaaaaaauuaaugagcuccaacucaacagacuugccauuaaacauagaaugcuucaugaaugauaaagacguauccgguaaaaugaauagaucccaguucgaggaacuaugugccgaacuacuucaaaaaauagaaguaccauuauacucacuauuagaacaaacucaccuaaaagucgaagacguaagugcaguagaaauuguagguggagcaacaagaauaccggcuguaaaagaaagaauagcaaaauucuuuggaaaagauauaucaacaacauuaaacgccgaugaagccguagcuagagggugcgcacuucaaugcgccauauuaucaccagcguuuaaagucagagaauucaguguuaccgaugcaguaccauucccaauaaguuuaauauggaaccaugacucagaagacaccgaaggaguucaugaaguauuuagccgaaaccacgccgcaccauuuaguaaaguauuaacauuucuaagacgugguccauuugagcuugaagcauuuuauucugauccacaaggaguaccauacccagaagcaaaaauaggcagauuugucguacaaaacguaucggcacaaaaagauggagaaaaaucacgagucaaaguaaaggugagaguaaacacacauggaauauucacaauaaguacagccagcaugguggaaaaaguuccaacagaagaaaacgaaaugagcagcgaagcagauauggaaugucuaaaccaaagaccgccagaaaacccagacacagauaagaauguccaacaagacaacucugaagcaggcacucaaccacaaguucaaacagaugcacaacaaacuucacaaucaccaccgucuccagaauuaaccagugaagaaaacaaaauacccgacgcagauaaagcaaacgaaaaaaaaguagaccaaccaccagaagcaaagaaaccaaaaauuaaagucgugaacguagaauuaccaauagaagcaaaucuaguauggcaauuaggcaaagaccuauuaaauauguauaucgagaccgaagguaaaaugauaaugcaagacaaauuagagaaagaacgaaaugaugcaaaaaaugcaguagaagaauauguauaugaauuuagagauaaacuauguggaccguacgaaaaauuuauaugugaacaagaccaucaaaauuuucuacgacuucuaacugagacagaagacuggcuauacgaagaaggagaagaucaagcaaaacaagcguauguagacaaacuagaagaauuaaugaagauagguacaccaguaaaaguacgauuccaagaagcagaagagagaccaaaaauguuugaagaacugggucaaagauuacaacacuaugcaaaaaucgccgcagacuuucgaaacaaagacgaaaaguauaaucauauagaugaaucagaaaugaaaaaagucgaaaaaagugucaacgaagugauggaguggaugaauaacguuaugaaugcacaagccaaaaaaagccuagaucaagauccuguaguaagagcacaagagaucaaaaccaaaauaaaagaacuaaauaacaccugcgagccagugguuacccagccaaaaccaaaaauagaaagucccaaauuagagagaacccccaauggaccaaauauagauaaaaaagaagaagaccuagaggauaaaaauaacuucggagccgaaccaccacaccaaaauggggaauguuaccccaacgaaaaaaauaguguaaacauggauuuagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6841 - RNA, 3276 nt, Artificial Sequence
  mRNA product Design5 comprising derived and/or modified sequence from Homo sapiens__NP_006380.1 __HsHYOU1 (opt6)
gggagagucccgcagucggcguccagcggcucugcuuguucgugugugugucguugcaggccuuauucaagcuuaccauggcugauaaagucagacgacaacggccaagaagaaggguaugcugggcacugguagcaguucugcuagccgauuuauuagcguuaucagauacccuagcuguaaugagcguagacuuaggcagugaaaguaugaaaguggcaauaguaaaaccaggaguacccauggagauuguuuuaaauaaagaaucaagaagaaagacgccaguaauaguaacgcuaaaagagaacgaaagauucuuuggagacucagcagcaaguauggcaauuaaaaacccaaaagcaacccugagauacuuucaacaucuguugggcaaacaagcagacaacccacauguagcgcuauaccaagcgagguuuccugaacacgaacuaacauucgacccacaaagacaaacaguacacuuccaaauaucuucacaacuccaauuuucaccugaggaaguacuuggaauggucuuaaacuacagucgaaguuuggcggaagauuuugccgaacaaccuauaaaagaugcaguaauaacaguaccuguauucuuuaaucaagccgagaggagagcuguauuacaagcugcaagaauggcuggacuuaaaguacuacaacucauaaaugacaauacagcuacugcacuaucauaugguguuuuuagaagaaaagacauaaacacaacugcacaaaauaucauguuuuacgauaugggaagcggaagcacagucugcacuauagucaccuaucagauggugaaaacaaaagaagcaggaaugcagccucaauuacaaauaagaggaguagguuuugacagaacgcuggguggauuagaaauggaacugagauuaagagaacgauuggcaggacuauucaaugagcaacgaaagggucagagagcuaaagacguuagagaaaauccucgcgcaauggcuaaacuuuuacgcgaagcaaauagauuaaagacaguacuuagugcaaacgcagaccauauggcucaaauagaaggacuaauggaugacguagacuuuaaagcaaaaguaacacgaguagaguucgaagaacuaugugcagaucucuuugaaagaguaccugguccaguacaacaagcucuacaaagugcugaaaugucuuuagacgaaauugaacaaguaauauuggucggcggagcaacacgaguuccuagaguacaagaaguauugcuuaaggcaguaggaaaagaagaacuagggaaaaauauaaacgcugacgaagcagcagcaaugggagccguuuaccaagcggcagcacuaagcaaggcuuuuaaaguuaaaccauuuguaguaagagaugcaguuguauauccaauuuuaguagaauuuacucgagaaguagaagaagaaccagggauacacucacuaaaacacaacaaaagaguacucuuuagcaggaugggaccguauccacaacguaaagucauaacauuuaacagauauucucaugauuuuaauuuccauauaaacuacggagacuuaggcuuuuuagguccagaagaucuaaggguauuugguucacaaaaucucacaacgguuaaacuaaaagggguaggagauaguuucaagaaauacccagacuaugaaucuaaaggaauaaaagcacauuuuaaucuagaugaaagugggguauugagucuagaccgagucgagagcguauucgaaacucugguugaagauagugccgaagaggaaucaaccuugacuaaacuagguaauacgauaagcagcuuauucggagguggcacaacaccagaugcaaaagaaaauggaacagacacaguacaggaagaagaagaaagcccggcagagggcucaaaagaugaaccuggggaacaaguagaguuaaaagaagaagcagaagcaccaguggaagacgguucgcaaccaccucccccagagccaaaaggugaugcaacaccagaaggcgaaaaagcaacagaaaaagaaaauggggauaaaucagaagcacaaaagccaagugaaaaagcagaagcuggaccagaaggaguugcuccugcaccagaaggagaaaagaaacaaaaacccgcacgcaaaagaagaaugguagaggaaauaggugucgagcuaguaguauuagaucuaccagaucucccagaagacaaauuggcacaaaguguacaaaaacugcaggacuuaaccuuaagagacuuagaaaaacaagaaagggaaaaagcugcaaauucuuuggaagcauucauauucgaaacacaggacaaauuauaucaacccgaauaucaggaaguauccacagaagaacaaagagaagaaauaucaggaaaacucucagcagcaucaacgugguuggaagaugaaggaguaggugcaacaacaguaauguuaaaagaaaaauuagcagaacuaaggaaacugugccaaggauuauuuuucagagucgaagaaagaaagaaauggccagaacgguuaucugcauuagauaauuuacuaaaccacucuaguauguuucuaaaaggggccagauuaauaccagaaauggaucaaauuuuuacugaaguagaaaugacaacacuagaaaaaguaaucaacgaaacaugggcauggaaaaaugcaacuuuagcagaacaagcaaaauuaccggcaacagaaaaaccagucuuacuaucaaaagacauagaagcgaaaaugauggcauuagacagagaaguccaauaccuacuaaacaaagcaaaguucacaaaacccagaccgcggccaaaagauaaaaacggaacccgagccgagccaccacuaaaugcaagcgcaagugaucaaggggagaagguaauaccgccugcaggacaaacagaagacgcagaaccaaucuccgaaccagaaaaaguagaaacaggaucggaaccuggagauacagaaccccuagaauuaggaggaccuggagcugagccagaacaaaaagaacaaaguacaggacaaaaacgaccucuuaaaaaugacgaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6842 - RNA, 2475 nt, Artificial Sequence
  mRNA product Design5 comprising derived and/or modified sequence from Homo sapiens__NP_005339.3 __HsHSP90AA1 (opt6)
gggagagucccgcagucggcguccagcggcucugcuuguucgugugugugucguugcaggccuuauucaagcuuaccaugccagaagaaacccaaacacaagaccaacccauggaagaagaggaaguagaaacauucgcuuuccaagcagaaauugcacaauuaaugagucuaauuauaaacacauucuacucaaacaaagaaauauuuuuacgcgaacuaauaagcaacucaagcgaugcauuagauaaaauuagauaugaaucguuaacagauccaagcaaauuagacucaggaaaagaauuacacauaaaucuuaucccaaacaaacaagauagaacacuuaccauagucgacaccggaauaggaaugacaaaagcugaccuaauaaacaauuuagguacaauagcaaaaucggguaccaaagcauucauggaagcacuacaagcaggugccgacaucucgaugauaggacaauuuggaguaggauucuacagcgcauaccuaguagcagagaaaguaacaguuauaacaaagcacaacgacgacgaacaauacgccugggaaucaagugcaggaggaucauucacaguaagaacagacacaggugaaccaaugggcagagguacgaaaguaauacuucaucuuaaagaagaccaaacagaauaccuagaggaaagaagaaucaaagaaauaguaaaaaaacacucacaauucauaggauauccaauaacacucuuuguagagaaagaaagagacaaagaagucagugacgaugaagcagaggaaaaagaagauaaagaagaagaaaaagaaaaagaagaaaaagaaagugaagacaaaccagaaauagaagacguaggaucggaugaggaggaagaaaaaaaagauggagacaaaaaaaaaaagaaaaaaauaaaagaaaaauacauagaucaagaagaacugaacaaaaccaaaccaauauggacaaggaaccccgacgacaucacaaacgaagaauacggagaauuuuacaaaucacuuacaaaugacugggaagaccaccucgccgucaaacacuuuagcguagaaggucaauuagaauucagagcccuacuguuuguaccuagaagagcaccauucgauuuguuugagaauagaaaaaaaaaaaauaauaucaaacuauacguaagaagaguauuuauaauggacaauugcgaagaauuaauaccagaauaucuaaauuuuaucaggggaguagucgacagcgaagauuuaccauuaaacauaucgcgagagauguuacaacaaucaaaaauucugaaaguaauaagaaaaaaucuagucaaaaaaugucuagaacuauucacagaacuagcagaagacaaagaaaacuacaaaaaauucuaugaacaauucucaaaaaauauaaaauugggcauacacgaagacucucagaauagaaaaaaacuaucagaauuacuaagauauuauacgucagcuaguggagacgagaugguaucccuaaaagacuacugcacaaggaugaaagaaaaucaaaaacauauauacuacauaacuggagaaaccaaggaccaagucgcaaacucagcauucguagaaagauuacgaaagcauggacuggaaguaauauacaugauagaacccauagaugaauauugcguacaacaauuaaaagaauucgaaggaaaaacuuuaguaagcguaacgaaagaaggacuagaauuacccgaagaugaagaagagaaaaaaaaacaagaagagaaaaaaaccaaauucgaaaacuuauguaaaauaaugaaagacauauuagaaaaaaaaguagaaaaaguuguaguaucaaacagacuaguaacaagcccauguugcauaguaacaaguaccuacggguggacggcaaacauggaaagaauaaugaaagcccaagcuuuacgagacaauaguacgaugggauacauggcagccaaaaagcauuuagaaauaaacccagaccacagcauaaucgaaacacuuagacaaaaagccgaagcugauaaaaacgacaaauccgugaaagaccucgucaucuuacuuuaugaaacagcauuauuaaguaguggauucucccuagaagacccgcaaacacacgcuaaucgaauauaccgaaugauuaagcucggauuaggaauagacgaagaugacccaacagcggaugauacaagcgcagcaguaacugaagagaugccaccauuagaaggagaugaugauacgucaaggauggaagaagucgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6843 - RNA, 615 nt, Artificial Sequence
  mRNA product Design5 comprising derived and/or modified sequence from Homo sapiens__NG_005218__HsHSP90AA3P (opt6)
gggagagucccgcagucggcguccagcggcucugcuuguucgugugugugucguugcaggccuuauucaagcuuaccauggacucaagcaaacuagacagcggaaaaggacuacacauaaacuuaguaccaaacaaacaaaaccaaacacuaacaauaguagacacaagaauaggaaugacaaaaacagacuuaauaaacaaccuaggaacaguaacaaaaucaggaacaaaagcauucauggaagcacuacaagcagacgcagacauaucaaugauaggacacuucggaguaggauucuacucagcauaccuaguagcaaaaaaaguaacaguaauaucaaaacacaacaacgacgaacaauacacaugggaaucaucagcaggaggaucauucacaguaagaacagacgaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6844 - RNA, 2451 nt, Artificial Sequence
  mRNA product Design5 comprising derived and/or modified sequence from Homo sapiens__NP_031381.2__HsHSP90AB1 (opt6)
gggagagucccgcagucggcguccagcggcucugcuuguucgugugugugucguugcaggccuuauucaagcuuaccaugcccgaagaagugcaucauggcgaagaggagguagaaacauucgcuuuucaagcugaaauagcucagcuaaugagccuaauaauaaacacuuuuuacagcaacaaagaaauauuucuccgcgaguuaauaucaaacgcuucagaugcacuugauaaaauaagauacgagagccuaacagacccuaguaaacuagauagcgguaaagaacuaaaaauagacauaauacccaacccgcaagaaagaacacuuacacuugucgauacuggaauaggaaugacaaaagcagaucuaauaaauaacuuaggaacaauagcaaaaucagggacgaaagcguuuauggaagcauuacaagcaggagcagauauuaguaugauaggacaauuuggaguaggauucuacagugcuuaucuuguagcagaaaaaguaguaguaauaacaaaacacaaugacgacgaacaauaugcuugggaaucuucagccggagggucauucacgguuagagcagaccacggagaaccaauaggaagaggcacuaagguaauacuacauuuaaaggaagaucagacagaauaccuugaagaacgaagaguaaaagaaguaguaaaaaaacauucacaauuuauaggauaccccauaacauuauaccuggaaaaagaaagagaaaaagaaauaucugacgacgaagccgaagaagaaaaaggagaaaaagaagaagaagacaaagaugaugaagaaaaaccgaaaaucgaagacguaggaucagacgaagaagacgacucaggaaaagacaaaaaaaaaaaaacaaaaaaaauaaaagaaaaauacauagaucaagaagaauugaacaaaacaaaaccaauauggacaagaaauccagaugauauaacacaagaagaauauggagaauucuacaaaagucuuacaaaugacugggaagaccaucuagcagucaaacauuuuucaguagaaggacaacuagaauucagagcguuauuauuuauaccaagaagagcgccauucgaccuauuugaaaacaaaaaaaaaaaaaacaauauaaaacuauacguaagaagagucuucauaauggacucgugcgaugaauuaauaccagaauacuuaaauuucauaagaggaguagucgauuccgaagacuuaccacuaaauauaucucgagaaauguuacaacaauccaaaauacuaaaagugauaagaaaaaauaucguaaaaaaaugucuugaacuauuuucggaacuugcggaagacaaggaaaauuauaaaaaauuuuaugaagcguucaguaaaaacuuaaagcuaggcauacaugaagacuccacaaauagaagaagacuaagcgaacuauuaagauaccauacaucacaaucaggagacgaaaugacaucucuaagugaauaugugagcaggaugaaagaaacccaaaaaucaauauacuacauaacaggagaaucgaaagaacagguagcaaauucagcauucgucgaacguguacgcaaaagaggauuugaaguaguauacaugacugagccaauagacgaauauuguguacaacaacuaaaagaauucgacggaaaaagucuagucaguguaacaaaagaaggacuagaacuaccagaagaugaagaagaaaaaaaaaaaauggaagaaagcaaagcaaaguucgaaaauuuaugcaaauuaaugaaagaaauacuagauaaaaaagucgaaaaaguuacaauuucaaauagacuagucucaucaccaugcugcauagucacaagcacauacggauggaccgccaauauggaaagaauaaugaaggcacaagcauuaagagauaacagcacgaugggauacaugauggcaaaaaaacaucuugaaauaaauccagaccacccaauagucgaaacacuaagacagaaagcagaagcagauaaaaacgacaaagcuguaaaagaccucgugguccugcucuucgaaacagcauuacugaguucaggauucucgcuggaagacccacagacucauucaaauagaauuuacagaaugauaaaacuaggauuaggaaucgaugaagacgaaguggcagcagaagaaccaaacgccgcggucccagacgaaauaccuccauuagaaggagacgaggaugcaagccgaauggaagaaguagauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6845 - RNA, 2688 nt, Artificial Sequence
  mRNA product Design5 comprising derived and/or modified sequence from Homo sapiens__NP_003290.1__HsHSP90B1 (opt6)
gggagagucccgcagucggcguccagcggcucugcuuguucgugugugugucguugcaggccuuauucaagcuuaccaugcgagcuuuauggguacuaggcuuauguugcguauuacuuacauucggaucaguacgugcagacgaugaaguagauguagaugguacaguagaagaagauuuaggcaaaucaagagaaggaaguaggacagacgaugagguaguacaaagagaagaagaagcaauucaacuagacggacuuaacgcaucucaaauaagagaauuacgagaaaaaucagaaaaauuugcauuccaggcagaaguaaauagaaugaugaaacuaaucauaaauagucucuauaaaaacaaagaaauauucuuacgagaacuaauaucaaaugcaagugaugcuuuagacaaaauacgacuuaucagucuaacagaugaaaaugcacucaguggcaaugaagaacuaacaguuaaaauaaaaugcgauaaagagaaaaauuuacuacauguuacagacaccgguguaggaaugacaagagaagaauuaguuaaaaauuuaggaacaauagcaaaaaguggaacaagugaauuucuaaauaaaaugacugaagcucaggaagauggacaaagcacuucagaacuaauuggacaauucggaguaggauucuacucagcauuccuuguagcugauaaaguaaucguaacuagcaaacacaauaacgacacacaacauauaugggaaucagauucaaacgaauuuagcguaauugcagauccaagaggaaauacacuaggaagagggaccacaauaacauuaguacuaaaagaggaagcaagcgacuacuuagaacucgauacgauuaaaaauuuaguaaagaaauacucacaguuuauaaauuucccaauauacgucuggaguaguaaaacagaaacaguagaagaaccaauggaggaagaagaagcagccaaagaagaaaaagaagaaucggacgacgaagcugcugucgaagaagaagaagaagaaaagaaaccaaaaacaaagaaaguagagaaaacuguuugggauugggaauuaaugaacgauaucaaaccaauauggcaaagacccucaaaagaagucgaagaagacgaauauaaagccuuuuacaagucauuuuccaaagaaucggaugacccaauggcauauauucacuuuacagcagagggagaagucacauuuaaaucuauacuuuuugucccaacaagugcaccgagaggauuauuugaugaauacgguucaaagaaaucagacuauauaaaauuauauguaagaagaguguucauaacagacgacuuucacgauaugaugccgaaauacuuaaacuuuguuaaaggagucguugacagcgaugaccuaccacucaacguaaguagagaaacacuacaacaacauaaacuauugaaaguuauaagaaagaaacucguaagaaaaacuuuagacaugauuaagaaaauagcagacgacaaauauaacgauacauuuuggaaagaguucgguacaaauauaaaacuaggaguaauagaagaccacaguaauagaacccgauuagccaaauuacucagguuccaaucaucgcaucacccaacagacaucacgagcuuagaucaauauguagaaagaaugaaagaaaaacaagauaaaauauacuuuauggcgggaucaucaagaaaagaagccgaaucuucuccauucguugaacgacuauuaaagaaaggauaugaaguaauauaccuaacagaaccuguagaugaauauuguauacaagcacuaccagaauuugauggcaaacgcuuccaaaauguagcaaaagaaggcguuaaauuugaugaaagcgaaaagacaaaagaaaguagagaagcgguugaaaaagaguucgaaccauuauuaaauuggaugaaagacaaagcacuaaaagauaaaauagaaaaagcuguaguaucucaaagauuaaccgaauccccgugcgcacucguagccagucaauauggcuggucagguaacauggaaagaauaaugaaagcucaagcauaucaaacaggaaaagauauaaguacgaacuauuacgcaucucaaaagaaaacauucgaaauaaauccaagacacccacugauaagagauauguuaaggcgaauaaaagaagaugaagacgacaaaacaguucuagacuuagcugucguacuauucgaaacagcaacauuaagaagcggauacuuacuaccagacacaaaagcauauggagauaggauagaacggauguuacgacuaagucucaacauagauccagaugccaaaguugaagaagaaccagaagaggaaccagaagagaccgcagaagacacaacagaagacacagaacaggacgaagacgaagaaauggacguaggaacugacgaagaagaagaaacagcaaaagaaucuacagcagaaaaagacgagcuguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6846 - RNA, 2391 nt, Artificial Sequence
  mRNA product Design5 comprising derived and/or modified sequence from Homo sapiens__NP_057376.2__HsTRAP1 (opt6)
gggagagucccgcagucggcguccagcggcucugcuuguucgugugugugucguugcaggccuuauucaagcuuaccauggcacgagaauuaagagcucuuuuacuaugggguagacgacugagaccauuauuaagggcgccagcccucgcagcaguaccaggaggaaaaccaauacucugcccaagaagaacaaccgcacaauuaggcccaagaagaaauccagcauggucauuacaagcuggaagacuauuuuccacccaaacagcagaagauaaagaagaacccuuacauucaauaauaucaagcacagaaucaguccaaggaucaacaucaaaacaugaauuucaagcagaaacaaagaaacuauuagauauuguugcuagaagccuuuauucugaaaaagaaguauuuauaagagaacuaauuaguaacgcuagcgacgccuuagaaaagcuaagacacaaguuaguaagugauggacaagcauuaccagaaauggaaauacaccugcaaaccaaugcagaaaaaggaacaauaaccauacaagauaccggcauaggaaugacacaagaagaauuaguaaguaaccuuggaacaauagcuagaagcggaucaaaagcauuccucgacgcacuacaaaaccaagcagaagcaucauccaaaauaauuggacaauuuggcguaggauucuauagugccuuuaugguagcagaucgugucgaagucuauucacgaucagcagcaccaggaucacuaggguaucaaugguuaucagacggauccgguguauucgaaauugccgaagccucgggcguaagaacggguacuaaaauaauaauacauuuaaaaucagauugcaaagaauucucuucagaagcacgaguccgagauguaguaacgaaauauucaaacuuuguuaguuuucccuuauauuuaaauggucguagaaugaauaccuuacaagcaauauggaugauggauccaaaagauguuagagaauggcaacaugaagaauuuuauagauauguugcucaagcucaugacaaaccccgauauacuuuacacuacaaaacagacgcaccauuaaauaucaggaguauauuuuaugugccagauaugaaacccucgauguuugaugucaguagagaauuaggaagcaguguggcucuauauucuagaaaaguacucauacaaaccaaagcaacggauauauuaccaaaauggcucagauuuauaagaggaguuguugauucagaagacauacccuuaaaucuuaguagagaacuacuucaagaaucagcauuaauaagaaaauuaagagacguccuucaacaaagauuaauuaaauucuuuauagaccaaucaaaaaaagaugcagaaaaauaugcaaaauucuucgaagacuauggauuauuuaugagagaaggaauaguaacagcaacagaacaagaaguaaaagaggauauagcaaaauuauuacgguacgaaucaucagcauuaccaucaggacaacuuacaucauuauccgaauacgccagucgaaugagagcaggcacaagaaacauauauuaccuaugugcaccaaacagacaucuagcagagcacucaccuuauuacgaagcaaugaaaaaaaaagauacagaaguucuauuuugcuuugaacaauuugacgagcuuaccuuacuccaucuaagagaauuugacaaaaaaaaauuaauaaguguugaaacagacauaguaguugaucauuauaaagaagaaaaauuugaagaucgaagcccagcagcagaaugccuaucagaaaaagaaaccgaagaauuaauggccuggaugcguaauguucuaggaagcagaguuacaaacguaaaaguaacgcuaagauuagauacucauccagccaugguaacugugcuagaaaugggcgcagccaggcacuuccuaagaaugcaacaauuagcaaaaacacaagaagaaagagcacaauuacuucaaccaacacuugagauaaaucccagacaugcauuaaucaaaaaacuaaaccaacuucgugcaagcgaaccaggauuagcacaacuuuuaguugaucaaauauaugaaaacgcaaugauagcagcuggacucgucgaugauccaagagcaauggugggacgccuuaaugaauuauugguaaaagcauuggaacgacauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6847 - RNA, 738 nt, Artificial Sequence
  mRNA product Design5 comprising derived and/or modified sequence from Homo sapiens__NP_000609.1__HsIGF1 (opt6)
gggagagucccgcagucggcguccagcggcucugcuuguucgugugugugucguugcaggccuuauucaagcuuaccaugggaaaaauaucaucacuaccaacacaacuauucaaaugcugcuucugcgacuuccuaaaaguaaaaaugcacacaaugucaucaucacaccuauucuaccuagcacuaugccuacuaacauucacaucaucagcaacagcaggaccagaaacacuaugcggcgcagaacuaguagacgcauuacaauucguaugcggagacagaggauucuacuucaacaaaccaacaggauacggaucaucaucaagaagagcaccacaaacaggcauaguagacgaaugcugcuuccgaucaugcgaccuaagaagacuagaaauguacugcgcaccacuaaaaccagcaaaaucagcaagaucaguaagagcacaaagacacacagacaugcccaaaacacaaaaagaaguacaccuaaaaaacgcauccagaggaucagcaggaaacaaaaacuacagaauguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6848 - RNA, 819 nt, Artificial Sequence
  mRNA product Design5 comprising derived and/or modified sequence from Homo sapiens__NP_000603.1__HsIGF2 (opt6)
gggagagucccgcagucggcguccagcggcucugcuuguucgugugugugucguugcaggccuuauucaagcuuaccaugggaauaccaaugggaaaaucaaugcuaguacuauuaacauuucuagcauuugcaagcuguugcauugcagcauacagaccaucagaaacacuauguggaggagaauuaguagauacauuacaauuuguauguggagauagaggauucuauuucucaagaccagcaucaagaguuagcagaagaaguagaggaauaguagaagaaugcuguuucagaagcugugauuuagcauuacuagaaacauauugcgcaacaccagcaaaaagugaaagagauguaucaacaccaccaacuguauuaccagauaacuuuccaagauacccaguaggaaaauucuuucaauacgauacauggaaacaaagcacacaaagacuaagaagaggacuaccagcauuauuaagagcaagaagaggacacguucuagcaaaagaacuagaagcauuuagagaagcaaaaagacauagaccacuaauagcauuaccaacacaagauccagcacacggaggagcaccaccagaaauggcaucaaacagaaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6849 - RNA, 915 nt, Artificial Sequence
  mRNA product Design5 comprising derived and/or modified sequence from Homo sapiens__NP_000591.1__HsIL6 (opt6)
gggagagucccgcagucggcguccagcggcucugcuuguucgugugugugucguugcaggccuuauucaagcuuaccaugaauuccuucucaacaucagccuucggaccaguagccuucucacuaggacuacuacuaguacuacccgcagcauucccagcaccagucccaccaggagaagacucaaaagacguagcagcaccacacagacaaccauuaacaucaucagaacgaauagacaaacaaauaagauacauauuagacggaauaucagcacuaagaaaagaaacaugcaacaaaucaaacaugugcgaaucaucaaaagaagcccuagcagaaaacaaccuuaaucuaccaaaaauggcagaaaaagacggaugcuuccaaucaggauucaacgaagaaacaugccuaguaaaaauaauaacaggacuacuagaauucgaaguauaccucgaauaccuacaaaacagauucgaauccucagaagaacaagcccgagcaguccaaaugucaacaaaaguacuaauacaauucuuacaaaaaaaagcaaaaaaucuagacgcaauaacaacaccagacccaacaacaaacgccuccuuacuaacaaaacuacaagcacaaaaccaaugguuacaagacaugacaacacaccucauacuaagaucauucaaagaauuccuacaauccucacuaagagcacuuagacaaauguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6850 - RNA, 1557 nt, Artificial Sequence
  mRNA product Design5 comprising derived and/or modified sequence from Homo sapiens__NP_002183.1__HsINHBA (opt6)
gggagagucccgcagucggcguccagcggcucugcuuguucgugugugugucguugcaggccuuauucaagcuuaccaugccacuacugugguuaagagguuuccuauuagcaagcugcuggauaauaguaagaagcaguccaacaccagggagcgaaggacacagugcggcaccagacugcccaucaugugcgcuagcagcauuaccaaaagacguuccaaauagucaaccagaaaugguugaagcaguaaaaaaacauauauuaaauaugcuacaucuaaaaaaaagaccagauguaacacaaccaguaccgaaagcagcauuauuaaaugcaauacgaaaauuacaugucggaaaaguaggagaaaacggauauguagaaauagaagacgacauuggaagaagagcagaaaugaacgaauuaauggaacaaacaagugaaauuauaacguuugcagaaucaggaacagccagaaaaacacuacacuuugaaauaucaaaagaaggcucagaccuaucaguuguagaaagagcggaaguaugguuauuucuaaaaguaccuaaagcaaacagaacaagaacaaaaguaacaauuagacuauuucaacaacaaaaacacccacaaggaagucuagauacaggagaagaagcagaagaaguaggauuaaaaggagaaaggagugaauuacuauuaagugaaaaaguaguagacgcaagaaaaucaacauggcacguauuuccaguaucaucaagcauacaacgacuacuagaccaaggaaaauccucauuagauguaagaaucgcaugcgaacaaugucaagaaaguggugcaucauuaguacuauuaggaaaaaaaaaaaaaaaagaagaagaaggagaaggaaaaaaaaaaggaggaggagaaggaggugcaggagcagacgaagaaaaagaacaaagccauagaccauucuuaauguuacaagcaagacaaagugaagaccauccucauaggagaagaagaagaggacuugaaugcgacggaaaaguaaauauauguuguaaaaaacaauucuuuguaagcuuuaaagauauaggauggaacgauuggauaauagcuccaaguggauaucacgcaaauuacugcgaaggagaaugcccaucacacauagcgggaacaagcggaagcucacuaucauuccauagcacaguaauaaaccauuacagaaugagaggacauaguccauucgcaaacuuaaaaucaugcugugucccaacaaaacuaagaccaauguccauguuauauuaugaugacggucaaaauauaauaaaaaaagauauacaaaacaugauaguagaagaauguggcuguagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6851 - RNA, 1500 nt, Artificial Sequence
  mRNA product Design5 comprising derived and/or modified sequence from Homo sapiens__NP_002184.2__HsINHBB (opt6)
gggagagucccgcagucggcguccagcggcucugcuuguucgugugugugucguugcaggccuuauucaagcuuaccauggauggauuacccgggagggcacuaggugcagcuugccuauuacuacuagcagcaggauggcuaggaccagaagcauggggaagcccgacaccaccuccuacaccagcagcaccaccaccaccuccuccaccaggaucaccaggaggaagucaagacacauguacaucaugcggaggauuccgaagaccagaagaacuaggaagaguagauggagauuuucuagaagcaguuaaacgacauauacuaucuagacuacaaaugcgaggaagaccaaauauaacacacgcaguuccaaaagcagcaaugguaacagcacuuagaaaauuacaugcagguaaaguacgugaagauggaagaguagaaauaccacaucuagacggucacgcuucaccaggagcugacggucaagaaagaguaucagaaaucaucagcuuugccgaaacugauggacuagcaucaucacgaguuagauuauauuuuuuuauuaguaaugaaggaaaucaaaauuuauucguuguccaagcuucauuauggcuuuauuuaaaauuacuaccuuauguauuagaaaaaggaucaagaagaaaaguaagaguuaaagucuauuuccaagaacaaggucauggagauagauggaauaugguagaaaaaagaguagaccuaaaaagaucaggauggcacacuuucccauuaacagaagcaauacaagcauuauucgaaagaggagaaagaagacuaaauuuagacguucaaugugacucaugucaagaauuagcaguaguaccaguuuuugucgauccaggagaagaaagucauagaccuuuuguaguaguacaagcgagauuaggagauucaagacacagaauaaggaaaagaggauuagaaugugacgggagaacaaacuuauguuguagacaacaauuuuuuauagauuuucgacuaauaggauggaaugauuggauaauagcaccuacaggauauuauggaaauuauugugaaggaaguuguccagcauauuuagcaggaguaccaggaucagcaagcaguuuucauacagcaguaguuaaucaauauagaaugagaggacuaaauccuggaacgguaaauucguguugcauuccuacaaaacuaucaacaaugagcauguuauacuucgaugacgaauauaauauaguuaaaagagacguaccaaacaugauuguagaagaauguggaugugcuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6852 - RNA, 3735 nt, Artificial Sequence
  mRNA product Design5 comprising derived and/or modified sequence from Homo sapiens__NP_000623.2__HsITGAM (opt6)
gggagagucccgcagucggcguccagcggcucugcuuguucgugugugugucguugcaggccuuauucaagcuuaccauggcucucagaguacuacuacuaacugcacuaacuuuaugccacggcuucaacuuagauaccgaaaacgccaugacuuuucaagaaaaugcaagagguuucggacaaucuguaguacaacuacaaggcucaaggguaguuguaggcgccccucaagaaaucguagccgcuaaucagcgagguucucuuuaucaaugugauuauucaacuggauccugugaacccauccgauuacaaguaccuguagaagcuguaaauaugucacuuggacuaagucucgcugcaacaacaucacccccgcaacuacucgcauguggcccaaccguacaucagacauguucugaaaacacauacguaaaaggauuauguuuccuauuuggcaguaacuuacgacaacaaccacaaaaauucccagaagccuuaagaggauguccucaagaagauagcgauauugcauuccucauagauggaucugguuccauuauaccucaugauuuccggcgaaugaaagaauuuguuucaacagucauggaacaacuaaagaaaucaaaaacauuauuuuccuuaaugcaauauagugaagaguuccgaauacauuuuaccuucaaagaauuucaaaauaacccaaacccgcgaagucucguaaaacccauuacccaacuucuagguagaacucacacagcaacagguauuagaaaaguuguucgagaguuauuuaauauuacaaacggagcacguaaaaacgcuuucaaaauccuaguuguaauaacagacggagaaaaauuuggugacccacuagguuaugaagauguuaucccagaggcugacagagaaggagucauuagauaugucauaggaguaggagaugcauuccgcagugagaaaaguagacaggaacuuaacacgauagccucuaaacccccaagggaucacgucuuccaaguaaacaacuuugaggcuuuaaaaaccauacaaaaccaauugcgugagaaaauuuuugcuauagaagggacacaaacuggauccucaucuucauuugaacaugaaaugucucaagaaggauuuucagcagccaucacaucaaacggaccuuuacuaucaaccguuggcuccuaugauugggcuggaggagucuuccuuuauacuucuaaagaaaaauccacuuuuauaaauaugacccggguugauagcgacaugaaugacgccuauuuggguuaugcagcugcuauaauacuacgaaaucguguccaaaguuuaguccuaggagcucccagauaucagcauauugguuuaguugcgauguuuagacaaaacacagguaugugggaaucaaaugcaaauguuaaaggaacacaaauuggggcauauuucggcgcuucccuauguucaguagacgucgauucaaauggauccacggauuuaguucucauaggugcaccacacuauuaugaacaaacccgagguggccaagucuccguaugcccccuaccacgcggccgugcacguuggcagugcgacgcuguacuuuauggugaacaaggacaaccuuggggacguuuuggagcagcccuaacuguacuuggagacguuaauggcgacaaauuaacggauguugcgaucggggcaccaggcgaagaagauaauagaggagccguauacuuauuucauggcacaagcggcucaggaauaucaccuucacauagucaaagaauagcaggaucaaaacuaucuccaagauuacaauacuuugggcaaagucuaagcggcggacaagaccuuacaauggauggauuaguagaucuaaccguuggagcacaaggacauguauuauuauuaagaucccaaccuguucuuagagucaaagcuauuauggaauuuaacccuagagaaguagcucgcaauguuuuugaauguaaugaucagguuguuaaagguaaagaagcaggagaaguccguguuugucuucacguacagaaaucaacuagggauagacuaagagaaggacaaauacaaaguguuguuacauaugauuuagcacuagacucuggucgaccacauucaagagcaguuuucaacgagacuaaaaacucaacacgaagacaaacccagguauuagguuuaacacaaacuugcgaaacacuuaaacuacaauuaccuaauugcauagaagauccaguuucaccaauaguccuacgauuaaacuucucauuaguuggcaccccacuguccgcuuucggaaaccuacgucccguccucgcagaagacgcacaaagacuauuuacagcuuuauucccuuuugaaaagaauugcggcaaugauaauauaugucaagacgaucuuucaauuacuuuuaguuuuaugucacuagauugccuaguaguaggaggaccaagagaauuuaauguaacaguuacaguacgcaacgacggagaagacucuuaucgaacacaaguuacauuuuucuuuccauuagacuuaaguuaccgaaaaguaucaacccuucaaaaucaacgaucacaaagaucauggagguuagccugcgaaucggcaucauccacugaaguaucuggugcacucaaaaguacuucauguuccauuaaucauccuauauuuccugaaaauuccgaaguaaccuuuaacauaacauuugauguugauucaaaagccucucucgguaauaaauuacuacuuaaagcaaacgugacauccgaaaauaacaugccaagaacuaauaaaacggaauuucaauuagaauuaccuguuaaguacgcagucuacaugguugugacaagucauggcguuuccacaaaauaucuuaacuuuacagcaagugaaaacacaucaaggguuaugcaacaucaauaucaagucaguaaccuuggucaacgaagccuaccaaucucauuggucuuucucgucccaguaagacuaaaucaaaccguaauaugggaucgaccgcaaguuacuuucagugaaaacuuaaguucuacaugccacacaaaagaaagacuuccaucucacucugacuuucuagcugaacuacgaaaagcucccguuguaaacuguucuauagcaguuugucaacguauacaaugugauauuccauucuuuggaauacaagaagaguucaaugcuacauuaaaagguaauuuaucguuugauugguacauuaaaacuagccauaaucauuuauuaauaguuucuacugcagaaauccuguuuaaugauuccguauucacucuauuacccggacaaggagcauuuguaagaucccaaaccgaaacaaaaguagaaccuuuugaaguccccaacccucuuccuuuaaucguuggaucaagcguuggcggacuauuacuuuuagccuuaauaacggcggcauuauauaaauuaggauucuucaaacgccaauauaaagauaugaugucugaagguggaccuccuggagcagaaccacaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6853 - RNA, 1680 nt, Artificial Sequence
  mRNA product Design5 comprising derived and/or modified sequence from Homo sapiens__NP_002415.1__HsMMP8 (opt6)
gggagagucccgcagucggcguccagcggcucugcuuguucgugugugugucguugcaggccuuauucaagcuuaccauguuuucacuaaaaacauuaccuuuccuacuucuacuacacguacaaauaucaaaagcauuuccagucucaucaaaagaaaaaaacacaaaaacaguacaagauuaucucgaaaaauuuuaccaauuaccaucaaaucaauaucaaucaacacgaaaaaauggaacaaacguaauaguugaaaaauuaaaagaaaugcaaagauucuuuggacucaaugucacaggcaaaccuaacgaagaaacacuagacaugaugaaaaaaccaagaugcggaguaccagacucaggaggauucauguuaaccccaggcaacccuaaaugggaaagaacaaaucuaacauacagaauacgaaacuauacaccacaacuauccgaagcagaagucgaaagagcaauaaaagacgcuuuugaacuuuggucaguagccuccccacuaauauucacacgaauaucacaaggagaagccgacaucaacauagcauuuuaucaacgagaccacggagacaauucccccuucgacggaccaaauggaauacuagcacacgcauuccaaccuggacaaggaauaggaggagaugcacauuucgacgcagaagaaacauggacaaacacaucagcaaacuacaaccuauucuuagucgcagcacacgaauucggacauucucuaggacuagcccauucaucugaccccggcgcacuaauguauccaaacuacgcauuuagagaaacauccaacuacucccuaccccaagacgauauagaugguauccaagcaauauacggacuauccucaaauccaauacaaccaacaggccccucuacaccaaaaccaugcgacccaucccuuacauucgacgcaauaacaacccuccgaggagaaauauuauucuuuaaagacagauacuucuggagaagacacccucaacuccaacgaguugaaaugaacuucauaucuuuauuuuggccaucucuaccaacagggauccaagcagcuuacgaagauuuugaucgcgacuuaauauuuuuauucaaaggaaaucaauacugggcauuaucaggauaugauauacuacaaggauaccccaaagacauaucaaauuauggauuccccuccucaguccaagccaucgacgcugcaguauucuaccgaucaaaaaccuacuucuuuguaaaugaccaauuuuggagauacgauaaucaacgucaauucauggaaccugguuauccaaaaucaauaucuggcgcauuucccggaauagaaagcaaaguagacgcagucuuucaacaagaacacuucuuccacguauuuagcggaccaagauacuacgccuuugacuuaauagcacaaagaguaacacgaguugcaagaggaaacaaauggcuaaacuguagauacggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6854 - RNA, 2400 nt, Artificial Sequence
  mRNA product Design5 comprising derived and/or modified sequence from Homo sapiens__NP_004985.2__HsMMP9 (opt6)
gggagagucccgcagucggcguccagcggcucugcuuguucgugugugugucguugcaggccuuauucaagcuuaccaugagucuauggcaaccauuaguauuaguuuuacuuguacucgguuguugcuucgcugcaccuagacaacgucaaucaacccucgugcucuuuccaggagaucuucgaacuaauuuaacagauagacaauuagcagaagaauauuuauauagguauggcuauacacgaguagcugaaaugcgaggagaaaguaaaagccuaggaccugccuuauuacuacuacaaaaacaacuaucauuaccagaaacuggagaauuagacuccgcuacucuaaaagcaaugcgcaccccacguugcggaguaccagauuuaggacgauuucaaacauuugaaggagauuuaaaauggcaucaucacaauauaacauacuggauucaaaacuacagugaagauuuacccagggcaguaauagacgaugcauuugcaagggcauuugcauuauggucagcuguuacuccacucacuuucacuagaguuuacaguagagaugcagauaucguaauacaauuuggaguagcagaacacggcgacggauacccauucgacgguaaagauggacuacuagcucaugccuucccaccagguccagguauacaaggagacgcacauuuugaugaugaugaauuauggaguuuaggcaagggaguugucguaccaacucgauuuggaaaugcugauggugcagcuugccauuuucccuuuauuuucgaagggagaucguauucagcuugcacaacagacggaagauccgauggucuaccauggugcucuacaacagcuaacuaugacacagacgauagauucggauucugcccauccgaacgauuauauacucaagauggaaaugcagacgguaaaccaugucaauucccauuuauauuccaaggacaaucauauagcgcuugcacaacagauggaagaagcgauggauacagauggugcgcaacaacagcuaacuaugaucgagacaaacuauuuggauuuuguccaacacgugcugauuccacaguaaugggaggaaauucugcuggugaacuauguguauucccauuuacauuccuugguaaagaauacucuacauguacaagcgaaggcagaggcgacggaagacuuuggugugcuacaacaucuaauuuugauagugauaaaaaauggggauucuguccagaccaaggauacucauuauuucuaguagcugcacaugaauuuggacaugccuuaggauuagaucauaguucuguaccagaagcucugauguauccuauguaccgauucacugaaggaccaccacuccauaaagacgauguuaauggaauaagacauuuguacggacccaggccagaaccagaaccaagaccaccaacaacaacaacuccucaaccgacagcaccaccaacaguuuguccaacaggaccccccacaguacauccaucagaaagaccuacagcaggaccaacagguccgccaucagccggaccaacuggaccuccaacagcaggccccuccacagcaacaacaguaccauuaucaccaguagaugaugcaugcaauguaaauauauuugaugcuauagcagagauaggcaaucaacuauaucucuuuaaagacggaaaauauuggagauucucagagggcagaggaucaagaccccaaggaccauuuuuaauugcagauaaauggccagcuuuaccaaggaaauuagauucagucuuugaagagcgccucucaaaaaaauuauuuuuuuucucaggaagacaagucuggguuuauaccggagcauccguauuaggaccaagaagauuagacaaauuagguuuaggugcugaugucgcacaaguuacaggagcuuuacgaagcggucgaggaaaaaugcuacuguucucugguagaagacuauggagauuugacguaaaagcgcaaaugguagacccucgaagcgcuagugaaguagauagaauguucccugguguaccucuugacacccaugacguuuuucaauacagagaaaaagcauauuuuugccaagaucgcuucuacuggcgaguuaguucacguagcgaacuaaaucaaguagaccaaguuggauaugucacauacgauauacuacaauguccagaagacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6855 - RNA, 1692 nt, Artificial Sequence
  mRNA product Design5 comprising derived and/or modified sequence from Homo sapiens__NP_002418.1__HsMMP13 (opt6)
gggagagucccgcagucggcguccagcggcucugcuuguucgugugugugucguugcaggccuuauucaagcuuaccaugcacccagguguacuugcagccuucuuauuuuuaucauggacucacuguagagcacucccacuaccaucaggaggagacgaagaugauuuaucagaagaagaccuccaauucgcagaaagauaucuaagaucuuacuaucacccaacaaacuuagcagguauacuaaaagaaaacgcagcaucaucaaugacagaaagacuaagagaaaugcaaucauucuuuggauuagaaguaacaggaaaacuagaugauaauacacuagacguaaugaaaaaacccagaugcggaguaccugauguaggagaauacaacguauucccaagaacacuaaaauggucaaaaaugaaucuaacauacagaaucguaaacuauaccccagacaugacacauagugaaguagaaaaagcauucaaaaaagcauucaaaguauggucagacguaacaccauuaaacuucaccagacuucacgauggaauagcagacauuaugauuucauuuggcauaaaagaacauggcgacuucuacccauucgacgguccaagcgguuuacuagcccaugcauucccaccuggaccuaacuauggcggagacgcacacuuugacgaugacgaaacauggaccaguucaaguaaaggauacaaucuauuuuugguagcugcccacgaauucggccacucacuaggacuagaccauucaaaagacccuggugcauuaauguucccaauauauaccuauacaggaaaaucacauuucauguuaccagaugaugauguacaaggcauccaaucauuauacggcccaggagacgaagauccaaacccaaaacacccaaaaacaccagacaaaugcgacccuucacuaucucuagacgcaauaacuucuuuaagaggagaaacaaugauauucaaagaucgauucuucuggagacuucacccacaacaaguagaugcagaacuauucuuaacaaaaucuuucuggccagaacuaccaaaccguaucgacgcagcauaugaacacccaucacaugacuuaauauuuauauuuagaggacgaaaauuuugggcauuaaacggauaugauauauuagaaggauacccuaaaaaaauaucagaacucggauuaccaaaagaaguuaaaaaaauaucggcagcuguacacuucgaagacacaggcaaaacccuauuauuuucaggaaaccaaguauggcgauaugacgacacaaaucauauaauggauaaagauuacccaagauuaauagaagaagauuucccaggaauaggugacaaaguagacgcaguauacgaaaaaaaugguuacauauauuuuuuuaacggacccauacaauucgaauacucaauauggucaaacagaauaguacgagucaugccagcaaauucgauacuuuggugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6856 - RNA, 1344 nt, Artificial Sequence
  mRNA product Design5 comprising derived and/or modified sequence from Homo sapiens__NP_001286.1__HsCCR1 (opt6)
gggagagucccgcagucggcguccagcggcucugcuuguucgugugugugucguugcaggccuuauucaagcuuaccauggaaacaccaaacacaacagaagacuacgauacaacaacugaauucgacuacggagacgcaacaccaugucaaaaagucaacgaacgagcauucggagcacaauuacuaccuccacuauacucauuaguauuuguaauaggcuuagucggaaacauacuaguaguacuaguuuuaguucaauacaaaagacuaaaaaacaugacaucuauauacuuacuaaacuuagcaauaucagaucuucuauucuuauucacccuuccauucuggauagacuacaaauuaaaagacgacuggguauucggcgacgcaaugugcaaaauauuauccggauucuauuacacaggacuauacucagaaauauuuuucauaauacuccuaacaauagacagauaccuagcaauaguucacgcaguauucgcuuuaagagcaagaaccguaacauucggaguuauaacaucaauuauaaucugggcacuagccauacuagccucaaugccaggacuauacuucucuaaaacucaaugggaauucacacaccauacauguucacuccacuuuccccaugaauccuuaagagaauggaaacucuuccaagcacuaaaauuaaacuuauucggacuaguauuaccacuacuaguaaugauaauaugcuacacaggaauuauaaaaauccuacuuagaagaccaaacgaaaaaaaaucaaaagcagucagacuaauauucgucauaaugauaaucuuuuuuuuauucuggacaccuuacaaucucacuaucuuaauaucaguuuuccaagacuuccuauucacacacgaaugugaacaaucaagacacuuagacuuagcaguacaagucacugaaguaauagcauacacacacugcugcguaaacccaguaaucuacgcauucguaggagaaagauuuagaaaauaccuaagacaacuauuccacagaagaguugcuguacaccuaguaaaaugguuacccuucuuaucagucgaucguuuagaaagagucucaucaacaucacccucaacaggugaacacgaacuaucagccggauuuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6857 - RNA, 912 nt, Artificial Sequence
  mRNA product Design5 comprising derived and/or modified sequence from Homo sapiens__NP_002598.4__HsPDGFA (opt6)
gggagagucccgcagucggcguccagcggcucugcuuguucgugugugugucguugcaggccuuauucaagcuuaccaugagaacauuagcaugcuuauuacuauuaggauguggauacuuagcacacguauuagcggaagaagcagaaauaccaagagaaguaauagaaagacuagcacgaucacaaauacacucaauaagggaccuacaaagauuacuagaaauagacucaguaggaagcgaagacucacuagacacaucauuaagagcacacggaguacacgcaacaaaacacguaccagaaaaaagaccacuaccaauaagaagaaaaagaagcauagaagaagcaguaccagcaguaugcaaaacaagaacaguaauauaugaaauaccacgaucacaaguagacccaacaucagcaaacuucuuaauauggccaccaugcguagaagugaaaagaugcacaggcugcugcaacacaucgucaguaaaaugccaaccaagcagaguacaccacagaucaguaaaaguagcuaaaguagaauacguaagaaaaaaaccaaaacuaaaagaaguacaaguaagacuagaagaacaccuagaaugcgcaugcgcaacaacaagccuaaacccagacuaccgagaagaagauacaggaagaccgcgagaaaguggaaaaaaacgaaaaagaaaaagacuaaaaccaaccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6858 - RNA, 1002 nt, Artificial Sequence
  mRNA product Design5 comprising derived and/or modified sequence from Homo sapiens__NP_002599.1__HsPDGFB (opt6)
gggagagucccgcagucggcguccagcggcucugcuuguucgugugugugucguugcaggccuuauucaagcuuaccaugaauagaugcugggcacuauucuuaagcuuauguugcuacuuaagacuaguaucagcagaaggagauccaauaccagaagaauuauacgaaaugcuaagcgaccacucaaucagaagcuuugacgauuuacaaagacuacuacauggagauccaggagaagaagacggagcagaacuagacuuaaauaugacaagaucacacucaggaggagaauuagaaucacuagcaagaggaagaagaagucuaggaucacuaacaauagcggaaccagcaaugauagcagaauguaaaacacgaacagaaguauucgaaauaucaagaagauuaauagacagaacaaaugcaaacuuccuaguauggccaccaugcguagaaguacaaagaugcucaggauguugcaauaacagaaacguacaauguaggccaacacaaguacaauuaagaccagugcaaguaagaaaaauagaaauaguacguaaaaaaccaauauuuaaaaaagcaacaguaacacuagaagaccaucuagcauguaaaugcgaaacaguagcagcggccagaccaguaacaagaagcccaggaggaagucaagaacaaagagcaaaaacaccacaaacuagaguuacaauaagaacaguaagaguaagaagaccaccaaaaggaaaacauagaaaauucaaacacacacaugauaaaacagcacuaaaagaaaccuuaggagcaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6859 - RNA, 1314 nt, Artificial Sequence
  mRNA product Design5 comprising derived and/or modified sequence from Homo sapiens__NP_057289.1__HsPDGFC (opt6)
gggagagucccgcagucggcguccagcggcucugcuuguucgugugugugucguugcaggccuuauucaagcuuaccaugagcuuauucggacuacuacuccuuacuucagcacuagcaggacaaagacaaggaacacaagcagaaucaaaccuaagcucaaaauuccaauuuucaucaaacaaagaacaaaauggaguacaagauccacaacacgaaaggauuauuacagucucaacaaacggaaguauacacaguccaagauucccacauacauacccaagaaacacaguuuuagucuggcgacuaguagcaguagaagaaaauguauggauacaacuaacauucgaugaaagauucggauuagaagacccagaagacgacauaugcaaauaugacuuuguagaagucgaagaaccaagugacgguacaauacuaggaagauggugcggaucaggaacaguaccaggcaaacaaauaaguaaaggaaaccaaauuagaauaagauucguaucagaugaauacuuuccaucagaaccaggauucugcauacauuacaacauaguaaugccacaauucaccgaagcaguuucaccaucaguuuuaccaccaagugcccucccauuagaccuacuaaacaacgcaauaacugcauucaguacucuagaagaccuaauaagauaccuagaaccagaaagauggcaauuagaucucgaagaccuauauagaccaacauggcaacuauuaggcaaagcauuuguauucggaagaaaaucaagaguaguagacuuaaaccuauuaacagaagaaguaagacuauacagcugcacaccaagaaacuuuucaguuucaauaagagaagaauuaaaaagaacagauacaaucuucuggccaggaugucuauuagucaaaagaugcggcggaaacugcgcaugcugccuacauaacugcaacgaaugccaaugcguaccaaguaaaguaacaaaaaaauaccacgaaguauuacaacuaagaccaaaaacuggaguaagaggucuacacaaaucacuaacugacguagcauuagaacaucacgaagaaugugacugcgucugcagaggaucaacaggaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6860 - RNA, 1371 nt, Artificial Sequence
  mRNA product Design5 comprising derived and/or modified sequence from Homo sapiens__NP_149126.1__HsPDGFD (opt6)
gggagagucccgcagucggcguccagcggcucugcuuguucgugugugugucguugcaggccuuauucaagcuuaccaugcacagacuaauauucguauacacacucauaugcgcaaauuucugcucauguagagacacaucagcaacaccacaaucagcaucaauaaaagcacuaagaaacgccaaccuaagacgagacgauuuauacagaagagacgaaacaauacaaguaaaagguaacggauauguacaaucaccaagauucccaaacaguuacccaagaaaucuacuacuaacauggagacuacacucacaagaaaacacaagaauacaacuaguauuugacaaccaauuuggacuagaagaagcugaaaacgacauauguagauaugacuucguagaaguagaagacauaagugaaacaucaacaauaauuagaggaagauggugcggccacaaagaaguaccaccccgaauaaaaucaaggacaaaccaaaucaaaauaacuuucaaaucagacgacuacuuuguagcaaaaccaggcuuuaaaauauacuauagcuuacuagaagacuuccaaccagcagccgcaagugaaacaaacugggaaagcguaacaucaagcaucucaggaguaagcuauaacucaccaucaguaacagacccaacacuaauagcagacgcauuagacaaaaaaauagcagaauucgacacaguagaagauuuauuaaaauacuucaacccagaaucauggcaagaagaccuagaaaauauguaccucgacacaccaagauauagaggaagaagcuaucacgauagaaaaucaaaaguagaccuagacagacuaaaugacgacgcuaaacgauauaguuguacaccaagaaacuacagugucaacauacgagaagaacuaaaacuagcaaacguaguauucuuuccacgaugucuacuaguacaaagauguggaggaaacugcggaugcggaacaguaaauuggagaucaugcaccugcaacagcggaaaaacaguuaaaaaauaccacgaaguacuacaauucgaaccuggccacauaaaacgaaggggaagagcaaaaaccauggcacuaguagauauccaacuagaucaucacgagagaugugacuguauauguaguucaagaccaccaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6861 - RNA, 954 nt, Artificial Sequence
  mRNA product Design5 comprising derived and/or modified sequence from Homo sapiens__NP_003946.3__HsSOCS3 (opt6)
gggagagucccgcagucggcguccagcggcucugcuuguucgugugugugucguugcaggccuuauucaagcuuaccaugguaacacacucaaaauucccagcagcaggaaugucaagaccauuagacacaucauuaagacuaaaaacauucucaucaaaaucagaauaucaacuaguaguaaacgcaguaagaaaacuacaagaaucaggauucuacuggucagcaguaacaggaggagaagccaaccuacuccuaucagcagaaccagcaggaaccuuccuaauaagagacucaucagaccaacgacacuucuucacacuaucaguaaaaacacaauccggaacaaaaaaccucagaauacaaugcgaaggaggaucauucucacuacaaucagacccacgcuccacacaaccaguaccaagauucgacugcguacuaaaacuaguacaccacuacaugccaccaccaggagccccaucauuuccaucaccaccaacagaaccaucaucagaaguacccgaacaaccaucagcacaaccacuccccggaucaccaccaagaagagcauacuacauauacucaggaggagaaaaaauaccauuaguacuauccagaccauuaucuucaaacgucgcaacacuacaacaucuaugcagaaaaacaguaaacggacacuuagacucauacgaaaaaguaacccaacuaccaggccccauacgagaauuccuagaccaauacgacgcaccacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6862 - RNA, 759 nt, Artificial Sequence
  mRNA product Design5 comprising derived and/or modified sequence from Homo sapiens__NP_003227.1__HsTGFA (opt6)
gggagagucccgcagucggcguccagcggcucugcuuguucgugugugugucguugcaggccuuauucaagcuuaccaugguaccaucagcaggacaauuagcauuauucgcauuaggaauaguauuagcagcaugucaagcauuagaaaauucaacaucaccacuaucagcagauccaccaguagcagcagcuguaguaucacauuuuaaugacuguccagauucacauacucaauucuguuuucauggaacauguagauucuuaguacaagaagacaaaccagcauguguaugucauucaggauauguaggagcaagaugugaacaugcagauuuauuagcaguagucgcagcaucacaaaaaaaacaagcaauaacagcauuaguaguaguaucaauaguagcauuagcaguacuaauuauaacauguguacuaauacauuguugucaaguaagaaaacauugugaauggugcagagcauuaauauguagacaugaaaaaccaucagcauuauuaaaaggaagaacagcauguugucauucagaaacaguaguauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6863 - RNA, 1449 nt, Artificial Sequence
  mRNA product Design5 comprising derived and/or modified sequence from Homo sapiens__NP_000651.3__HsTGFB1 (opt6)
gggagagucccgcagucggcguccagcggcucugcuuguucgugugugugucguugcaggccuuauucaagcuuaccaugccaccuagcggacucagauuauuacccuuacuacucccacuccuauggcuacuaguacuaacuccaggaagaccagcagcaggacuaaguacauguaaaacuauagacauggaauuaguaaaaagaaaaagaauagaagccauacguggacaaauccuaucuaaauugagacuagccucaccuccaucacaaggagaaguaccaccaggaccccuacccgaagcaguacuagcacuauacaacucaacaagagauagaguagcaggagaaucagcagaaccagaaccagaaccagaagcagauuauuacgcaaaagaaguaacacgcguauuaaugguagaaacacauaacgaaauauaugauaaauucaaacaaucuacacacucuauauacauguucuuuaauacaucagaacucagagaagccguacccgaaccaguauuauuaucaagagcagaacuaagacuucuaagacuaaaacucaaaguugaacaacacguagaacuauaccaaaaauacucaaacaauucuuggagauauuuaucuaacagacuacuagcccccucagacuccccugaauggcuaucauucgacguaacaggaguagucagacaaugguuaucuagaggaggagaaauagaaggauuccgacuuucagcacacuguucuugugauagucgcgacaacacauuacaaguagacauaaacgguuucacaacuggacguagaggagaccuugcaacaauacaugguaugaacagaccauucuuacuacuaauggcaacaccacucgaacgagcacaacaucuacaauccucacgccacagacgagcccuagacacaaacuacugcuucucaucaaccgaaaaaaauuguugcguaagacaauuauacauagauuucagaaaagaccuaggauggaaauggauacaugaaccuaaaggauaccacgccaauuuuuguuuaggcccauguccauacauauggucacuagacacacaauacucuaaaguauuagcucuauacaaccaacacaacccaggcgcaucagcagcaccaugcuguguuccacaagcuuuagaaccauuaccaaucguauauuacguaggaagaaaacccaaaguagaacaauuaucaaacaugauagucagaucauguaaaugcucuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6864 - RNA, 1521 nt, Artificial Sequence
  mRNA product Design5 comprising derived and/or modified sequence from Homo sapiens__NP_003229.1__HsTGFB2 (opt6)
gggagagucccgcagucggcguccagcggcucugcuuguucgugugugugucguugcaggccuuauucaagcuuaccaugcauuacugcguacuaucagcauuccuaauacuacaccuaguaacaguagcauuaucccuaucaacuugcuccacccuagacauggaccaauuuaugagaaaacgcauagaagcaauaagaggacaaauuuuaucaaaacucaaacuaacaagcccaccagaagacuacccagaaccagaagaaguaccaccggaagucauuucaauauacaauucaacaagagaccuacuacaagaaaaagcaucaagaagagcugcagcaugugaaagagaacgcagcgacgaagaauacuacgcaaaagaaguauacaaaaucgacaugccuccauucuucccaagcgaaaacgcaauaccaccaacauucuaucgaccauauuuuagaauaguaagauucgacgucucagccauggaaaaaaaugcuagcaauuuaguaaaagcagaauuuagaguuuucagacuacaaaacccaaaagcacgaguccccgaacaacgaauagaauuauaccaaauacuaaaaucaaaagaccuaacauccccaacacaaagauacauagacucaaaaguaguuaaaacccgagcagaaggcgaauggcuaucuuucgauguaacagacgcaguacacgaaugguuacaccacaaagauagaaaccuagguuucaaaauaucucuccacugcccaugcugcacauucguaccauccaacaacuacauaauaccaaacaaaucugaagaauuagaagcaagauucgcaggaauagacgguacaucaaccuacacaucaggagaucaaaaaacaauaaaauccacaagaaaaaaaaauucaggaaaaacaccacaccuacuacuaaugcuacuaccaagcuacagauuagaaucacaacaaacaaacagacgaaaaaaaagagcacuagaugcagcauacugcuucagaaacguacaagacaacugcugucuccgcccacuauacauagauuucaaacgagauuuaggauggaaauggauacacgaacccaaaggauauaacgccaacuucugcgcaggagcaugcccauauuuauggucauccgacacccaacacuccagaguccuaucucucuacaacaccauaaacccagaagcaucagcaucacccugcuguguaucccaagacuuagaaccacuuacaauauuauacuacauaggaaaaacaccaaaaauagaacaacuaucaaacaugauagucaaauccuguaaaugcucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6865 - RNA, 1515 nt, Artificial Sequence
  mRNA product Design5 comprising derived and/or modified sequence from Homo sapiens__NP_003230.1__HsTGFB3 (opt6)
gggagagucccgcagucggcguccagcggcucugcuuguucgugugugugucguugcaggccuuauucaagcuuaccaugaaaaugcacuuacaaagagcauuaguuguacuagcacuucucaacuuugcaacaguaucacuaucauuaucaaccugcacaacacuagacuuuggacacauaaaaaaaaaacgaguagaagccauaagaggacaaauacuaucaaaacuaagacuaacaucaccaccagaaccaaccguaaugacacacgucccauaccaaguauuagcccuauacaacaguacaagagaacuacucgaagaaaugcacggagaacgagaagaaggaugcacucaagaaaauacagaaucagaauacuacgcaaaagaaauacacaaauuugauaugauacaaggauuagcagaacacaaugaacuagccguaugcccaaaaggaauaacaucaaaaguauuuagauuuaacguaucaucagucgaaaaaaaccgcacaaaucuuuucagagcagaauuucgagugcuacgaguaccaaauccaucaucaaaaagaaacgaacaacgcauagaacuauuucaaauccuacgaccagacgaacacauagcaaaacaaagauacauaggaggcaaaaaccuccccacaagagguaccgcagaaugguuaucauucgaugucaccgacacaguacgagaaugguuacuaagaagagaaucaaaccuaggcuuagaaauaucaauccacugcccaugccacaccuuucaaccaaauggagacauauuagaaaacauacacgaaguuauggaaauaaaauucaaaggaguagauaaugaagaugaccacggacgaggugaucuuggaagacuaaaaaaacaaaaagaccaccacaacccacaucuaauauuaaugaugauaccuccacacagauuagacaaccccggacagggaggacaaagaaaaaaaagagcacuagauacaaacuauugcuucagaaaccuagaagaaaacugcugcgucagaccuuuauacauagauuucagacaagaucucggauggaaauggguccacgaaccaaaaggauacuaugcaaacuuuugcuccggccccugcccauaucuacgaucagcagacacaacacacucaacaguacucggacuuuauaacacucuaaaccccgaagcauccgccuccccaugcuguguuccacaagacuuagaaccacuaacaauauuauacuauguaggacgaacaccaaaaguugaacaauuaagcaacaugguaguaaaaucaugcaaauguagcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6866 - RNA, 1662 nt, Artificial Sequence
  mRNA product Design5 comprising derived and/or modified sequence from Homo sapiens__NP_001057.1__HsTNFRSF1B (opt6)
gggagagucccgcagucggcguccagcggcucugcuuguucgugugugugucguugcaggccuuauucaagcuuaccauggcacccguagcugucugggcagcauuagcaguuggauuagaauuaugggcagcugcccacgcacuaccagcccaaguagcauucacaccuuacgccccagaaccuggaucuaccugcagacuaagagaauauuacgaucaaacagcucaaauguguuguucaaaauguucaccaggccaacaugcaaaaguauucuguacaaaaacaucagauacaguaugugauucaugcgaagauucaacuuauacacaauuauggaauuggguucccgaaugccuauccuguggaucaagauguucaucagaucaaguagaaacccaagcauguacaagagaacaaaauagaauauguacaugcagaccagguugguauugugcacuaagcaaacaagaaggaugcagauuaugugccccauuaagaaaaugucgaccaggcuucggaguagcacgaccuggaaccgaaaccucugauguaguaugcaaaccaugugcaccaggaacauuuucaaacacaacaucuucaacagacauaugcagaccacaccaaauauguaacguuguagcaauaccuggcaaugccucaauggaugcaguuuguacaucaacauccccaacaagaucuauggcaccaggagccguacauuuaccacaaccaguuaguacucgaucacaacauacccaacccacacccgaaccauccacugcuccguccaccucauuccuacuaccaaugggacccucuccaccagcugaagguucuacaggagacuucgcacuaccaguuggauuaauaguaggaguaaccgcacuaggacuucuaaucauaggaguaguuaauuguguaaucaugacucaaguuaaaaaaaaaccuuuauguuuacaacgagaagcaaaaguaccacauuuaccggcagauaaagcaagaggaacucaaggaccagaacaacaacaucuauuaauuacagcuccaucaucaucaucaucaucacuagaaucaucagcuucagcacuugaucgaagagcaccuacacguaaccaaccacaagcaccagguguggaagcuucaggugcaggagaagcaagagcaaguacaggaucaucagacaguucaccaggaggucauggaacacaaguaaauguaacuuguauaguaaaugucuguagcucaucagaucauucaucccaaugcucaucucaagccuccucaacaaugggagacacagauuccucuccaucagaaucaccaaaagacgaacaaguaccauuuucaaaagaagaaugugccuucagaucacaacuagaaacaccagaaacuuuauuaggaucaacugaagaaaaaccgcuacccuuaggaguaccagacgccggaaugaaacccucuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6867 - RNA, 789 nt, Artificial Sequence
  mRNA product Design5 comprising derived and/or modified sequence from Homo sapiens__NP_002623.2__HsPGF (opt6)
gggagagucccgcagucggcguccagcggcucugcuuguucgugugugugucguugcaggccuuauucaagcuuaccaugccaguaaugagauuauuuccauguuuucuacaauuauuagcaggauuagcacuaccagcaguaccaccacaacaaugggcauuaucagcaggaaauggaaguucagaaguagaaguaguaccauuucaagaaguguggggaagaucauauuguagagcauuagaaagauuaguagauguaguaagugaauauccaagugaaguagaacauauguuuucaccaaguuguguaaguuuauuaagauguacagguuguuguggagaugaaaaccuacauuguguaccaguagaaacagcaaauguaacaaugcaauuauuaaaaauaagaaguggagauagaccaucauauguugaauuaacauuuagucaacauguaagaugugaaugcagaccacuaagagaaaaaaugaaaccagaaagaagacgaccaaaaggaagaggaaaaagaagaagagaaaaacaaagaccaacagauugucauuuauguggagaugcaguaccaagaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6868 - RNA, 1515 nt, Artificial Sequence
  mRNA product Design5 comprising derived and/or modified sequence from Homo sapiens__NP_001020537.2__HsVEGFA (opt6)
gggagagucccgcagucggcguccagcggcucugcuuguucgugugugugucguugcaggccuuauucaagcuuaccaugacagauagacaaacugauacagcaccgaguccgaguuaucauuuauuaccaggaagaaggagaacaguagaugcagcagcaucaagaggacaaggaccugaaccagcaccaggaggagggguagaaggaguuggagcuagaggaguagcauuaaaauuauuuguccaguuauuaggaugcaguagauuuggaggagccguaguaagggcaggagaagcagaaccaucaggggcagcacgaagugcaucaaguggaagagaagaaccacaaccagaagaaggagaagaagaagaggagaaagaagaagaaagaggaccacaauggcggcugggugcgagaaaaccaggaaguuggacaggagaagcagcaguaugcgcagauucagcucccgcagcgagagcaccucaagcauuagcaagagcaagcggaagaggaggaagaguagcaagaagaggagcagaagaaucagggccaccucauagcccaaguagaagggguagugcaaguagagcaggaccaggaagagcaagcgaaacaaugaauuuuuuauuaagcuggguacauuggucauuagcgcuauuacuauauuuacaucaugcaaaauggagccaagcagcaccaauggcagaaggaggaggucaaaaccaucacgaaguaguaaaauuuauggauguuuaucaaaggucauacugccacccaauagaaacacuaguagauauauuucaagaauacccagacgaaauagaauauauauuuaaaccaagcuguguaccacuaaugagaugugguggauguugcaacgaugaaggacuagaauguguaccaacagaagaaucuaauauaacaaugcagauaaugagaauaaaaccacaccaaggacaacauauaggagaaaugaguuuuuuacaacauaauaaaugugaauguagaccaaaaaaggauagagcaaggcaagaaaaaaaaucaguaagaggcaaaggaaaaggacaaaaaaggaaaagaaaaaagagcagauauaaaaguuggagcguguauguaggagcaagaugcugucuaaugccauggucacuaccaggaccucauccauguggaccauguagugaacgaagaaaacaucuauuuguacaggauccacaaacauguaaauguagcuguaaaaauacagauaguagauguaaagcaaggcaauuagaauuaaaugaaaggacuuguagaugcgauaaaccuagaagguagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6869 - RNA, 975 nt, Artificial Sequence
  mRNA product Design5 comprising derived and/or modified sequence from Homo sapiens__NP_001165094.1__HsVEGFA (opt6)
gggagagucccgcagucggcguccagcggcucugcuuguucgugugugugucguugcaggccuuauucaagcuuaccaugaacuuucuauuaagcuggguacauuggucacuugcauuauuacuauauuuacaucacgcaaaauggagccaagcagcaccaauggcagaaggaggaggacaaaaccaucacgaaguaguaaaauuuauggauguauaucaaaggaguuacugccauccaauagaaacacuaguggacauauuccaagaauauccagaugaaauagaauauauauuuaaaccaagcuguguaccacuaaugagauguggaggaugcuguaacgaugaaggacuagaaugcguaccaacagaagaaagcaauauaacaaugcaaauaaugagaauaaaaccacaccaaggacaacacauaggagaaaugucauucuuacaacauaacaaaugcgaaugcagaccaaaaaaagaucgagcaagacaagaaaaaaaaucaguaagaggaaaaggaaaaggacaaaaaagaaaaagaaaaaaaagcagauacaaaaguuggagcguauacguaggagcaagauguugcuuaaugccauggucacuaccaggaccacacccaugcggacccuguagcgaaagaagaaaacaucuauucguacaagacccacaaacaugcaaaugcucaugcaaaaacacagacucaagauguaaagcaagacaacuagaacuaaaugaaagaacauguagaugugacaaaccaagaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6870 - RNA, 900 nt, Artificial Sequence
  mRNA product Design5 comprising derived and/or modified sequence from Homo sapiens__NP_003368.1__HsVEGFB (opt6)
gggagagucccgcagucggcguccagcggcucugcuuguucgugugugugucguugcaggccuuauucaagcuuaccaugucaccauuacuaagaagacuauuacuagcagcauuauuacaacuagcaccagcacaagcaccaguaucacaaccugaugcaccaggacaucaaagaaaaguaguaucauggauagauguauauacaagagcaacaugccaaccaagagaaguaguaguaccacuaacaguagaauuaaugggaacaguagcaaaacaauuaguacccucaugcguaacaguacaaagaugcggagguuguuguccagacgauggacuagaauguguaccuacaggucaacaucaaguaagaaugcaaauauuaaugauaagauacccaaguucacaauuaggagaaaugucauuagaagaacauucacaaugcgaauguagaccaaaaaaaaaagacucagcaguaaaaccagacagagcagcaacaccacaccauagaccucaaccaagaucuguaccaggaugggacucagcaccaggagcuccaucaccagcagacauaacucauccaacaccagcaccaggacccucagcacaugcagcuccaucaacuacaucagcauuaacaccaggaccagcagcagcugcugcagacgcagcagccucaucaguagcaaaaggaggagcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6871 - RNA, 1536 nt, Artificial Sequence
  mRNA product Design5 comprising derived and/or modified sequence from Homo sapiens__NP_005420.1__HsVEGFC (opt6)
gggagagucccgcagucggcguccagcggcucugcuuguucgugugugugucguugcaggccuuauucaagcuuaccaugcaccuauuaggauuuuucucaguagcauguucauuacuugcagcagcauuacuccccggaccaagagaagcaccagcugcagcagcagcauucgaaucaggacuagaccuaagcgaugcagaaccagacgcaggagaagcaacagcauaugcaaguaaagaccuagaagaacaauuaagaaguguaucaucaguagacgaacuaaugacaguacucuaccccgaauacuggaaaauguacaaaugccaauuaagaaaaggaggauggcaacacaacagagaacaagcuaaccuaaacucaagaacugaagaaacaauaaaauuugcagcagcccacuacaauacagaaauauuaaaaucaaucgauaacgaauggcgaaaaacacaauguaugccaagagaaguuuguauagacguaggaaaagaauuuggaguugcaacaaauacauuuuuuaaaccaccaugcgucucaguauacagaugcggaggaugcugcaauagcgaaggauuacaauguaugaauacaucaacaagcuacuuaagcaaaacacuauuugaaauaacaguacccuuaucacaaggacccaaaccaguuacaauaaguuuugcaaaucauacuucaugcagauguaugaguaaauuagauguuuaucgccaaguacauucaauaauacgacgcagucuaccagcaacauuaccacaaugccaagcugcaaauaaaacaugcccaacuaauuauauguggaauaaucacaucugcagaugucuugcacaagaagacuucauguuuuccucagaugcaggagacgauucaacagacggcuuccacgacauauguggaccaaauaaagaacuagaugaagaaacaugucaaugcgucugcagagcaggauuaagaccagcaucauguggaccacacaaagaauuagacaggaauuccugccaauguguauguaaaaauaaacuauuuccaucacaaugcggagccaaucgagaauucgacgaaaauacaugccaaugugucuguaaaagaaccugucccagaaaucaaccauuaaacccuggaaaaugugccugugaaugcacagagucaccacaaaaauguuuacuaaaaggaaaaaaauuccaucaucaaacaugcuccuguuacagaagacccugcacaaacagacaaaaagcaugcgaaccaggauucagcuacagugaagaaguaugcagauguguaccaucauauuggaaacgaccacaaaugucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6872 - RNA, 1341 nt, Artificial Sequence
  mRNA product Design5 comprising derived and/or modified sequence from Homo sapiens__NP_004460.1__HsVEGFD (opt6)
gggagagucccgcagucggcguccagcggcucugcuuguucgugugugugucguugcaggccuuauucaagcuuaccauguacagagaauggguaguaguaaacguauucaugaugcuauacguacaauuaguacaagguuccucaaacgaacacggcccaguaaaaagaucaucccaaagcacacuagaaagaucugaacaacaaauaagagcagcaucuucacuagaagaacuuuuaagaauaacacacucagaagacuggaaacuauggagaugcagacuaagacuaaaaucauucacaucuauggacagcagguccgcaagucacagaucaaccagauucgccgcaacauuuuaugacauagaaacacucaaaguaauagacgaagaauggcaaagaacacaaugcaguccaagagaaacauguguagaaguagccucagaacuaggaaaaagcacuaacacauucuucaaaccaccaugcguaaauguauucagaugcggcggauguugcaacgaagaaucucucauauguaugaacacaaguacaucauacaucucaaaacaacuauucgaaauaucagucccauuaacaucaguaccagaacuaguaccaguaaaaguagcaaaccacacaggauguaaaugccuaccaacagcaccaagacacccauacaguaucauaagaagaucaauccaaauaccagaagaagaccgaugcucccacucaaaaaaauuaugcccaauagacaugcuaugggauucaaacaaaugcaaaugcguacuacaagaagaaaacccauuagcaggaacagaagaccacucucacuuacaagaaccagcauuaugcggaccacauaugauguucgacgaagauagaugugaauguguaugcaaaacuccaugcccaaaagaccuaauacaacacccaaaaaacugcucauguuucgaaugcaaagaaucucuagaaacaugcugccaaaaacacaaauuauuucacccagacacaugcucaugcgaagacagaugcccuuuccacaccagaccaugugccagcggaaaaacagcaugugcaaaacacuguagauuuccaaaagaaaaacgagcagcccaaggaccacacucaagaaaaaauccauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6873 - RNA, 906 nt, Artificial Sequence
  mRNA product Design5 comprising derived and/or modified sequence from Homo sapiens__NP_061986.1__HsFGF21 (opt7)
gggagagucccgcagucggcguccagcggcucugcuuguucgugugugugucguugcaggccuuauucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagcugcuguuggaagauggguauaacguguaccagagugaggcccacggccucccccugcaucugccagguaauaaaagcccgcacagggaccccgcaccacgggggcccgcccgcuuucucccacugcccggcuugccgcccgcccugccagaacccccaggcauccucgcaccccagccaccggaugugggguccagcgacccccugaguauggucgguccaucccagggcaggagccccuccuaugccaguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6874 - RNA, 1686 nt, Artificial Sequence
  mRNA product Design5 comprising derived and/or modified sequence from Homo sapiens__NP_002412.1__HsMMP1 (opt7)
gggagagucccgcagucggcguccagcggcucugcuuguucgugugugugucguugcaggccuuauucaagcuuaccaugcacagcuuucccccacugcuccuguugcuguucuggggcguggucucccauaguuucccggccacccucgagacucaggaacaagacguggaucugguacagaaguacuuggagaaauauuacaaccugaagaaugacgggaggcaaguggaaaaacggcgcaacagcggucccgucguggagaagcucaaacagaugcaggaauuuuucggccugaaggugaccgggaagccagaugcagagacgcugaaagucaugaagcagcccaggugcggcgugccagacguagcccaguuugugcucacugaggguaauccccggugggaacagacccaccugaccuaucgcaucgagaacuacacuccagauuugccgagggcggacgucgaucaugccauugaaaaagcauuccaacugugguccaaugugacgccccucaccuuuacuaaggugagugaggggcaggccgacaucaugauuagcuucguccggggcgaucaccgcgacaacuccccauuugauggccccggggguaaucuggcacaugccuuccagccaggccccgggaucggcggugacgcgcacuuugaugaggacgaaagguggaccaacaauuuccgggaguauaaccugcaccgcguggccgcacaugaauuggggcacagccucggccugucccauaguacugacauuggcgcccugauguacccgagcuauaccuucuccggggauguacagcucgcccaagacgauaucgacgguauccaggcaauuuacggcaggagccagaaucccgugcaaccaaucgggccccagaccccaaaagccugugauaguaagcugacguuugacgcgauuacuaccauccggggcgaggucauguucuuuaaagaucgcuucuacaugaggacuaaccccuuuuauccagaaguggaguugaauuucauuuccguguuuuggccgcagcugcccaacggucucgaggccgcauacgaguucgccgaccgggaugaaguccgcuuuuucaagggcaauaaguauugggcagugcaggggcaaaacguacugcacggcuacccaaaagacaucuauagcuccuuuggguuccccaggaccgugaagcacauugaugccgcccugagugaagagaacaccgguaaaacuuacuuuuucgucgcgaauaaguauuggcgguacgacgaauacaaacgcagcauggacccaggcuaucccaagaugaucgcacaugauuucccggggaucggccacaagguggacgccgucuuuaugaaagaugguuucuuuuacuucuuucauggcacgaggcaguauaaguucgacccaaaaaccaagcggauuuugacucuccagaaagccaacuccugguuuaauugcaggaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6875 - RNA, 1446 nt, Artificial Sequence
  mRNA product Design5 comprising derived and/or modified sequence from Homo sapiens__NP_002412.1__HsMMP1(1-19,100-469) (opt7)
gggagagucccgcagucggcguccagcggcucugcuuguucgugugugugucguugcaggccuuauucaagcuuaccaugcacagcuuucccccacugcuccuguugcuguucuggggcguggucucccauaguuucgugcucaccgaggggaacccgaggugggaacagacucaccugaccuaccggaucgagaauuauacgcccgacuugccacgcgccgauguagaccaugcaauugaaaaggccuuucaacuguggagcaacgugacuccccucaccuucaccaaagucuccgagggucaggcggauaucaugauuaguuuugugaggggcgaccaccgggauaauagcccauucgacgggcccggcgguaaccuggcccaugcauuucagccagggccgggcaucggcggggaugcccacuucgacgaagaugagcgcuggacuaauaacuuuagggaguacaaucugcaccggguggcagcccaugaacucggucacucccugggcuugagccauuccaccgacauuggggcgcugauguaucccaguuacacguucagcggcgauguccagcucgcccaagacgauaucgacgguauccaggcaauuuaugggcgcucccagaacccagugcagcccaucggcccacaaacucccaaggccugcgacagcaaacugaccuuugaugccauuacuaccaucaggggcgagguaauguucuucaaggaccgguuuuacaugcgcaccaauccguucuaucccgaaguggagcugaacuuuauuagugucuucuggccacaguugcccaaugggcucgaggcagccuacgaauuugcggauagggacgaggugcgguucuuuaaagguaacaaguacugggccgugcagggccagaauguccugcacggguauccaaaggauaucuacuccagcuucggcuuuccccgcacggugaaacacauugacgcagcccuguccgaagagaacacugguaagaccuauuucuuuguagcaaauaaauacuggagguaugaugaauacaagcggaguauggacccaggcuauccgaaaaugaucgcccaugauuuccccgggaucggccacaagguggacgccgucuuuaugaaagauggguucuucuacuuuuuccaugguacucgccaauacaaguuugacccaaagaccaaaaggauucucacccugcagaaggcgaacagcugguucaacugucggaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6876 - RNA, 3633 nt, Artificial Sequence
  mRNA product Design5 comprising derived and/or modified sequence from Clostridium histolyticum__BAA77453.1__ColG (opt7)
gggagagucccgcagucggcguccagcggcucugcuuguucgugugugugucguugcaggccuuauucaagcuuaccaugaagaaaaacauccugaagauucucauggacagcuacuccaaagagaguaagauccagaccgugaggcgggucacuagcgugucccuguuggccguauaucugaccaugaauacgaguagccucgugcuggcaaaacccauugaaaacacuaaugauaccuccaucaagaacgucgagaaguugcgcaaugccccaaacgaagagaauagcaaaaagguggaagacuccaaaaacgauaagguggagcacgucaaaaauauugaggaagcgaagguggagcaaguagccccggaagugaaaaguaagagcacccugagguccgcaagcaucgccaacacuaauagugagaaguacgacuucgaguaucucaacggccuguccuacaccgaacugacgaaucucaucaaaaacauuaaguggaaucagaucaacgggcuguuuaacuauagcacugguucccagaaauucuuuggcgauaagaaucggguccaggcaauuaucaacgccuugcaagagagugggcgcaccuacacugcgaaugacaugaaaggcauugaaaccuucaccgaggugcugagggccgguuuuuaucucggguacuacaacgauggccugagcuaucugaaugaccggaacuuccaggauaagugcauccccgcaaugauugccauccagaagaauccaaacuuuaaauugggcacggccgugcaggacgaagucaucacuucccucgggaagcugauugguaaugcaagcgccaacgcggaggugguaaauaacugugugcccguccugaaacaauuccgcgagaaucucaaccaguacgccccagauuaugugaagggcaccgcagugaaugaacugaucaaagggauugaguuugacuucaguggcgccgcauacgaaaaggaugucaagacuaugcccugguaugguaaaaucgacccauuuauuaacgaguugaaggcccuggggcucuacggcaacaucaccuccgccaccgaaugggcgagcgacgugggcaucuauuaccugaguaaauucgggcuguacuccacuaauaggaacgauauuguacagagcuuggagaaggcaguggacauguauaaauacgguaagaucgccuucgucgccauggagcggauuacgugggauuaugacggcaucgggagcaauggcaagaaaguggaucaugacaaguuucucgaugacgcagaaaaacacuaccugccgaagaccuauacuuucgauaacgguaccuuuauuauccgcgccggcgacaaagucuccgaggaaaagaucaaaaggcuguacugggcgagucgggagguaaagagccaguuccaucgcgugguggggaaugauaaggcccucgaagugggcaacgcagacgacguccugaccaugaaaauuuuuaauucccccgaggaguauaaguucaacacuaauaucaacggggugagcacggauaaugguggcuuguacauugaaccaagggggaccuuuuacacuuaugagcggacuccccaacagaguaucuucucccuggaggaacucuuucgccacgaguacacccauuaucugcaggccagguaccuggucgacggcuuguggggucaaggcccauucuaugagaaaaaccggcucaccugguuugaugaagggacggcagaguucuuugccggcagcacccgcacuuccggggugcugcccaggaagaguauucugggcuaccucgccaaagacaagguggaucaccgguauagccugaagaaaaccuugaacuccgguuacgacgauagcgacuggauguucuacaauuauggguucgcaguagcccacuaccuguaugaaaaggauaugccgacuuuuaucaaaaugaauaaggcgauucucaacaccgacgugaaaaguuacgaugaaaucaucaagaagcuguccgacgaugccaacaaaaauacggaguaucagaaccauauucaggagcuggcagacaaguaccagggcgccgguauccccuuggucagcgacgauuaucugaaagaccacggcuacaagaaagccuccgaaguguacagugagauuagcaaggcagcgucccucaccaauacuagcgucaccgccgagaaaagucaauauuucaacacuuuuacccugagggggacguacaccggcgaaacuuccaagggggaguucaaggauugggacgaaaugagcaaaaagcucgauggcacccuggaguccuuggccaaaaauagcuggagugguuauaagacucugaccgcauacuuuacgaacuaucgcgugaccagcgacaauaaagugcaguacgauguagucuuccauggggugcucacugacaacgccgauaucuccaauaacaaggcaccaauugccaaggugaccggccccaguacuggcgcggucgggcggaauaucgaauuuagcgguaaagacuccaaggaugaggacggcaaaaucgugagcuacgacugggauuucggggacggcgccaccuccagggguaagaacagugugcacgcauauaaaaaggccgggacguacaauguaacccugaaggucacugaugacaaaggcgccaccgcaacugagagcuuuaccauugaaaucaagaacgaagauacuaccacgccaauuaccaaagagauggagcccaaugacgauaucaaggaagccaacggcccaauuguggagggggugacugucaaaggugaccugaacggcuccgaugacgcggauaccuucuauuuugacgugaaggaagauggggacguaacuaucgaguugccguacaguggcagcuccaauuucaccuggcugguguauaaagagggugacgaucagaaccacaucgccagcgggauugacaagaauaacaguaaggucggcacguucaaauccaccaagggccgccauuacguguuuaucuauaaacacgauagcgcauccaauauuagcuacagucucaacaucaaggggcuggguaaugaaaaacucaaggagaaggaaaacaaugacuccagcgauaaagccacugugauucccaacuucaauaccacuaugcagggcagucuguugggggacgauucccgggacuacuauagcuuugaggucaaggaagagggcgaggugaacaucgaacuggauaaaaaggacgaguucgguguaaccuggacgcugcauccagaauccaauauuaacgauaggaucaccuacgggcaaguggacggcaauaaagucagcaacaaggugaagcuccgccccggcaaauauuaccuguugguguauaaguacagugggagcgguaacuaugagcugcgggucaauaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6877 - RNA, 3357 nt, Artificial Sequence
  mRNA product Design5 comprising derived and/or modified sequence from Clostridium histolyticum__BAA77453.1__HsALB(1-18)_ColG(111-1118) (opt7)
gggagagucccgcagucggcguccagcggcucugcuuguucgugugugugucguugcaggccuuauucaagcuuaccaugaagugggugaccuucaucagccugcucuuucuguucuccagugccuacagcauugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6878 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt7)
gggagagucccgcagucggcguccagcggcucugcuuguucgugugugugucguugcaggccuuauucaagcuuaccaugaagugggugaccuucaucagccugcucuuucuguucuccagugccuacagcaugaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6879 - RNA, 3381 nt, Artificial Sequence
  mRNA product Design5 comprising derived and/or modified sequence from Clostridium histolyticum__BAA34542.1__ColH (opt7)
gggagagucccgcagucggcguccagcggcucugcuuguucgugugugugucguugcaggccuuauucaagcuuaccaugaacuuccugaagaucauucucaauaggggcaaaaccaugaagcggaaaugccugagcaagcgcuugaugcuggccaucacuauggcaaccauuuuuacggugaacuccacucuccccaucuacgccgcggucgacaaaaauaacgccaccgcagccgugcagaaugagaguaagagguauaccguaagcuaccugaagacuuugaacuauuacgaucugguggaccuccuggucaaaaccgaaauugagaaucugccagaucucuuccaauauuccagugacgcaaaggaauuuuacgggaacaaaacgcggaugagcuucaucauggaugagaucggucgcagggccccgcaguauacugaaauugaccacaagggcauccccacccugguggaggugguccgggcgggguuuuacuugggcuuccauaauaaagagcugaacgaaauuaauaagcgcuccuuuaaagagagggugaucccaagcauucucgccauccagaagaaccccaauuucaagcuggguacugaaguacaggauaaaauuguguccgcaaccgggcuguuggccggcaacgagaccgccccacccgaggucgugaauaacuuuacgccaauccuccaagacuguaucaagaacauugaucgguacgcacuggacgaucugaaaaguaaggcccucuucaaugugcuggcggccccgacuuaugacaucaccgaauacuugcgcgcaacuaaagagaagcccgaaaacaccccaugguauggcaagauugauggguuuaucaaugagcugaaaaagcucgcccuguacgguaaaauuaacgacaauaacagcuggaucaucgacaauggcauuuaucacaucgcaccccuggggaaguugcauuccaacaauaaaauuggcaucgaaacccucacugaggucaugaagguguacccauaucugagcaugcagcaucugcagagugccgaucagauuaagaggcacuacgacuccaaagaugccgaggguaacaagaucccccucgacaaauucaagaaagaagggaaggagaaguacugcccgaaaacguauaccuucgaugacggcaagguaaucauuaaagcgggcgcacggguggaagaggaaaaggucaaacgccuguacugggccagcaaggaggugaauagucaauuuuucaggguguaugggaucgauaaacccuuggaggaagguaacccagacgauauucugacuauggucaucuacaauagucccgaggaauauaagcucaacagcgugcuguacggcuaugacaccaauaacgggggcauguacauugagccagaagguaccuuuuucacuuacgagcgggaggcccaggaauccacguauacccuggaggaauuguuucgccacgaguacacucacuaucuccagggcagguacgcaguacccgggcaguggggccggaccaagcuguaugauaacgaccgccugaccugguacgaggaagggggugccgaacucuucgcgggcagcacuaggacgagugggauccugccacggaaauccauugugagcaauauccauaacaccacuaggaauaaccgcuauaaguugagugacaccguccacuccaaauacggcgccagcuuugaguucuacaauuaugcauguauguuuauggauuacauguauaacaaggacauggguauccugaauaaacucaacgaucuggccaagaauaacgacguggauggcuacgacaauuauauucgggaucugagcuccaacuacgcauugaaugacaaguaucaagaucauaugcaggagaggaucgacaacuacgaaaaucugacugucccguucguggccgaugacuaccucgugcgccacgccuauaaaaaccccaacgagauuuacagugagaucagcgaaguagcaaagcugaaagaugccaaguccgaggugaaaaagagccaguauuuuaguaccuucacgcuccggggguccuacaccggcggggcgagcaagggcaaacuggaagaccaaaaggccaugaauaaauuuauugacgauuccuugaagaaacuggacacuuauaguuggagcgguuacaagacccucacugcauacuucaccaacuauaaagucgauuccagcaauagggugacguacgacgucguguuccacggguaucugccaaacgagggcgauaguaaaaauucccugcccuacgguaagaucaacggcaccuauaaggggacugaaaaggagaaaaucaaguuuagcuccgagggcaguuucgacccagaugggaaaauugugagcuacgaaugggacuuuggcgaugguaauaaguccaacgaggaaaaucccgagcauagcuaugacaagguagggaccuacacugugaaauugaaggucaccgaugacaaaggcgaaaguuccgugagcacgaccacugccgagaucaaggaccuguccgagaacaaacucccggucauuuacaugcacgugccaaagagcggcgcccugaaucagaaggugguauucuaugggaaagguaccuacgaucccgacggcaguaucgcaggguaucagugggauuuuggcgacgguagcgauuucuccagugaacagaaccccagccaugucuacacuaagaaaggggaguauaccgugacgcuccgcgugauggacuccagcggccaaauguccgaaaagaccaugaaaauuaagaucacugauccagucuaccccaucggcaccgagaaagagccaaauaacaguaaggaaacugcgagcgggccgauugugcccgguaucccaguguccggcaccauugagaauacuuccgaccaggauuauuuuuacuucgacguaaucacccccggggaagucaagauugauaucaacaaacugggcuacgguggggccacgugggugguguaugacgagaacaauaacgcagucagcuacgccaccgaugacggccagaauuuguccggcaaguuuaaagccgacaagccagggcgguauuacauucaccuguauauguucaacgguagcuacaugcccuauaggaucaauaucgaaggcaguguggggcggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6880 - RNA, 3342 nt, Artificial Sequence
  mRNA product Design5 comprising derived and/or modified sequence from Clostridium histolyticum__BAA34542.1__ColH (opt7)
gggagagucccgcagucggcguccagcggcucugcuuguucgugugugugucguugcaggccuuauucaagcuuaccaugaagaggaaaugccugagcaagcggcucaugcuggccaucaccauggcaacuauuuucaccgugaacuccacguugcccaucuacgccgcggucgacaaaaauaacgccacugcagccgugcagaaugagaguaagcgcuauaccguaagcuaccugaaaacccucaacuauuacgaucugguggacuugcuggucaagacugaaauugagaaucucccagaucuguuucaauauuccagugacgcaaaggaguucuacggcaacaaaaccaggaugagcuuuaucauggaugaaauugggcggcgcgccccgcaguauacggaaaucgaccacaaggguauccccacucugguggagguggucagggcgggcuucuaccucggguuucauaauaaagagcugaacgaaauuaauaagcgguccuucaaagagcgcgugaucccaagcauuuuggccauccagaagaaccccaauuuuaaacugggcaccgaaguacaggauaagauuguguccgcaacuggucuccuggccgggaacgagaccgccccacccgaggucgugaauaacuucaccccaauccugcaagacuguauuaagaauaucgauagguacgcauuggacgaucucaaaaguaaggcccuguuuaacgugcuggcggccccgacguaugacaucacugaauaccuccgggcaaccaaagagaagcccgaaaacacuccaugguauggcaaaauugauggcuucaucaaugagcugaagaaguuggcccuguacgggaaaauuaacgacaauaacagcuggaucauugacaaugguaucuaucacaucgcaccccucggcaagcugcauuccaacaauaaaauugggaucgaaacccugaccgaggucaugaagguguacccauauuugagcaugcagcaccuccagagugccgaucagauuaaacgccauuacgacuccaaggaugccgagggcaacaagaucccccuggacaaauuuaagaaagaagguaaggagaaauacugcccgaagacuuauacguucgaugacgggaagguaauuaucaaagcgggcgcaaggguggaagaggaaaaggucaaacggcuguacugggccagcaaggaggugaauagucaauucuuucgcguguauggcaucgauaaaccccucgaggaagggaacccagacgauauucugaccauggucaucuacaauagucccgaggaauauaaguugaacagcgugcuguacgguuaugacacuaauaacggcgggauguacauugagccagaaggcaccuucuuuaccuacgagagggaggcccaggaauccacuuauacgcucgaggaacuguuccggcacgaguacacccacuaucugcagggucgcuacgcaguacccggccagugggggaggacuaaauuguaugauaaugaccggcucaccugguacgaggaaggcggggccgagcuguuugcggguagcacccgcacuuccggcauccugccaaggaaguccauugugagcaacauccauaacacgacccggaauaacagguauaagcucagugacacuguccacuccaaauacggggccagcuucgaauuuuacaauuaugcauguauguucauggauuacauguauaacaaggacaugggcauucugaauaaauugaacgaucuggccaagaauaacgacguggaugguuacgacaauuauauccgcgaucucagcuccaacuacgcacugaaugacaaauaucaagaucauaugcaggagcggaucgacaacuacgaaaaucugaccgucccguuuguggccgaugacuacuuggugaggcacgccuauaagaaccccaaugagauuuacagugagaucagcgaaguagcaaagcugaaagaugccaaguccgaggugaaaaagagccaguauuucaguacuuuuacccuccgcggcuccuacacgggcggcgcgagcaaagggaagcuggaagaccaaaaggccaugaacaaauucauugacgauucccucaagaaacuggacaccuauaguuggagcggcuacaagacuuugaccgcauacuuuacuaacuauaaagucgauuccagcaaucgggugaccuacgacgucguguuccacgguuaucugccaaacgagggggauaguaaaaauucccuccccuacggcaagaucaacgguacguauaagggcaccgaaaaggagaaaauuaaguucagcuccgaggggaguuuugacccagauggcaaaaucgugagcuacgaaugggacuucggggauggcaauaaguccaacgaggaaaaucccgagcauagcuaugacaaaguagguacuuacaccgugaagcugaaggucacugaugacaaaggggaaaguuccgugagcaccacgaccgccgagaucaaggaccuguccgagaacaaauugccggucauuuacaugcacgugccaaagagcggcgcccugaaucagaaagugguauuuuauggcaaggggacuuacgaucccgacgguaguaucgcaggcuaucagugggauuucggggacggcagcgauuuuuccagugaacagaaccccagccaugucuacaccaagaaaggugaguauacugugacccucagggugauggacuccagcgggcaaauguccgaaaagacgaugaaaauuaagaucaccgauccagucuaccccauuggcacugagaaagagccaaauaacaguaaggaaaccgcgagcggcccgaucgugcccgggaucccaguguccgguacuauugagaauaccagugaccaggauuauuucuacuuugacguaaucacucccggcgaagucaaaauugauaucaacaagcugggguacggcggugccaccugggugguguaugacgagaauaacaacgcagucagcuacgccacggaugacgggcagaaucucuccggcaaguucaaagccgacaagccaggccgcuauuacauucaccuguauauguuuaacgggagcuacaugcccuaucggaucaauauugaagguaguguggggaggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6881 - RNA, 3276 nt, Artificial Sequence
  mRNA product Design5 comprising derived and/or modified sequence from Clostridium histolyticum__BAA34542.1__HsALB(1-18)_ColH(41-1021) (opt7)
gggagagucccgcagucggcguccagcggcucugcuuguucgugugugugucguugcaggccuuauucaagcuuaccaugaagugggugaccuucaucagccugcucuuucuguucuccagugccuacagcguccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6882 - RNA, 3414 nt, Artificial Sequence
  mRNA product Design5 comprising derived and/or modified sequence from Clostridium histolyticum__BAA34542.1__HsALB(1-18)_ColH(1-40)_CS-F_ColH(41-102 1) (opt7)
gggagagucccgcagucggcguccagcggcucugcuuguucgugugugugucguugcaggccuuauucaagcuuaccaugaagugggugaccuucaucagccugcucuuucuguucuccagugccuacagcaugaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6883 - RNA, 852 nt, Artificial Sequence
  mRNA product Design5 comprising derived and/or modified sequence from Homo sapiens__NP_001133.1__HsAMELX (opt7)
gggagagucccgcagucggcguccagcggcucugcuuguucgugugugugucguugcaggccuuauucaagcuuaccaugggcaccuggauccuguucgccugccuccugggggcagccuuugcgaugcccuugccaccgcaccccggucauccaggcuacauuaacuucagcuaugaggugcugacuccccucaagugguaccaguccaucaggccacccuauccaaguuacggguaugaaccgaugggcgguuggcugcaccaucaaauuauccccgucuugagccagcagcacccacccacccauacgcugcagccacaccaccauauucccgugguaccggcccaacagcccgugaucccacagcagcccaugaugccaguccccgggcaacacuccaugacuccaauccagcaucaccagccgaaucugcccccacccgcacagcaaccauaccagccccagccggugcaaccacagccccaccagcccaugcagccacaacccccagugcauccgaugcagccccucccaccccagccaccccugccgccaauguuucccaugcagccacugcccccgaugcuccccgacuugacccuggaggccuggccaaguaccgauaaaacuaagcgggaagaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6884 - RNA, 411 nt, Artificial Sequence
  mRNA product Design5 comprising derived and/or modified sequence from Homo sapiens__NP_001133.1__HsAMELX-TRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucaccccacugaagugguaccaguccauuaggccacccuaucccaguuacgguuaugaaccgaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6885 - RNA, 444 nt, Artificial Sequence
  mRNA product Design5 comprising derived and/or modified sequence from Homo sapiens__NP_001133.1__HsAMELX-LRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucacuccccugaagugguaccaguccauuaggccacccccaauguugccggaccugacccucgaagccuggcccaguaccgauaaaacgaagcgggaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6886 - RNA, 483 nt, Artificial Sequence
  mRNA product Design5 comprising derived and/or modified sequence from Homo sapiens__NP_001133.1__HLA-A2-SP_HsAMELX(17-60) (opt7)
gggagagucccgcagucggcguccagcggcucugcuuguucgugugugugucguugcaggccuuauucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguauucggcccccauauccgagcuacggcuaugaacccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6887 - RNA, 516 nt, Artificial Sequence
  mRNA product Design5 comprising derived and/or modified sequence from Homo sapiens__NP_001133.1__HLA-A2-SP_HsAMELX(17-47,168-191) (opt7)
gggagagucccgcagucggcguccagcggcucugcuuguucgugugugugucguugcaggccuuauucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguauucggcccccaccgaugcuccccgaccugacucuggaagcauggccaagcaccgauaaaaccaagcgcgaggaaguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6888 - RNA, 855 nt, Artificial Sequence
  mRNA product Design5 comprising derived and/or modified sequence from Homo sapiens__NP_001134.1__HsAMELY (opt7)
gggagagucccgcagucggcguccagcggcucugcuuguucgugugugugucguugcaggccuuauucaagcuuaccaugggcaccuggauccuguucgccugccucgugggggcagccuuugcgaugccccugccaccgcaccccggucauccaggcuacauuaacuucagcuaugaggucuugacuccccugaagugguaccaguccaugaucaggccacccuauaguagcuacggguaugaaccaaugggcgguuggcuccaccaucaaauuaucccggugguaucccagcagcacccccugacccauacguugcagagucaccaccauauuccagugguccccgcccaacagccacgggugcgccagcaggcacugaugcccgugccggggcaacagagcaugacucccacccagcaccaucagccaaaucucccccugccagcccaacagcccuuucagccacaaccgguccagccccagccacaccagcccaugcaaccacagcccccggugcagccaaugcagccccugcucccccaaccaccccugccaccgauguuccccuugaggccacugcccccaauccuccccgaccugcaccuggaggcauggccggccaccgauaaaacuaagcaggaagagguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6889 - RNA, 414 nt, Artificial Sequence
  mRNA product Design5 comprising derived and/or modified sequence from Homo sapiens__NP_001134.1__HsAMELY-TRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucaccccacugaagugguaccaguccaugauuaggccacccuauaguagcuacgguuaugaacccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6890 - RNA, 447 nt, Artificial Sequence
  mRNA product Design5 comprising derived and/or modified sequence from Homo sapiens__NP_001134.1__HsAMELY-LRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucacuccccugaagugguaccaguccaugauuaggccacccccaaucuugccggaccugcaccucgaagccuggcccgcaaccgauaaaaccaagcaagaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6891 - RNA, 486 nt, Artificial Sequence
  mRNA product Design5 comprising derived and/or modified sequence from Homo sapiens__NP_001134.1__HLA-A2-SP_HsAMELY(17-61) (opt7)
gggagagucccgcagucggcguccagcggcucugcuuguucgugugugugucguugcaggccuuauucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguaugauucggcccccauauagcuccuacggcuaugaaccgaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6892 - RNA, 519 nt, Artificial Sequence
  mRNA product Design5 comprising derived and/or modified sequence from Homo sapiens__NP_001134.1__HLA-A2-SP_HsAMELY(17-48,169-192) (opt7)
gggagagucccgcagucggcguccagcggcucugcuuguucgugugugugucguugcaggccuuauucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguaugauucggcccccaccgauccuccccgaccugcaccuggaagcauggccagccacugauaaaaccaagcaggaggaaguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6893 - RNA, 846 nt, Artificial Sequence
  mRNA product Design5 comprising derived and/or modified sequence from Sus scrofa__NP_999071.1__SsAMELX-001-1 (opt7)
gggagagucccgcagucggcguccagcggcucugcuuguucgugugugugucguugcaggccuuauucaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccauauaccaguuacggguaugaacccaugggcgguuggcugcaucaccaaauuaucccagucgugagccagcagacgccgcagucccaugcguugcaaccccaccaccauauuccaaugguacccgcccagcagccagggaucccccagcaaccgaugaugccccugccaggccagcacaguaugacucccacccagcaucaccagccaaaccucccccugccagcacaacagccguuucagccccaaccagugcagccccagccacaccagccccugcaaccgcagagcccaaugcaucccauccagccccuccugccacagcccccauugccgcccauguucuccaugcaaagccugcucccagaccugccccuggaggccuggccagcaaccgauaaaacuaagcgggaagaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6894 - RNA, 414 nt, Artificial Sequence
  mRNA product Design5 comprising derived and/or modified sequence from Sus scrofa__NP_999071.1__SsAMELX-TRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucacuccccugaagugguaccagaauaugauuaggcacccauauaccuccuacgguuaugaacccaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6895 - RNA, 447 nt, Artificial Sequence
  mRNA product Design5 comprising derived and/or modified sequence from Sus scrofa__NP_999071.1__SsAMELX-LRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucacuccccugaagugguaccagaauaugauuaggcacccauccuugcugcccgaccucccacuggaagccuggccggcaaccgauaaaaccaagcgggaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6896 - RNA, 486 nt, Artificial Sequence
  mRNA product Design5 comprising derived and/or modified sequence from Sus scrofa__NP_999071.1__HLA-A2-SP_SsAMEL(17-61) (opt7)
gggagagucccgcagucggcguccagcggcucugcuuguucgugugugugucguugcaggccuuauucaagcuuaccauggccgugauggcacccaggacucugguccuccuguugagcggcgcccuggcgcucacucagaccugggccaugccacugccgccccacccagggcaucccgguuacaucaacuucuccuaugagguguugacgccacugaagugguaccaaaauaugauucggcaccccuauaccaguuacggcuaugaaccaaugggcggguggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6897 - RNA, 519 nt, Artificial Sequence
  mRNA product Design5 comprising derived and/or modified sequence from Sus scrofa__NP_999071.1__HLA-A2-SP_SsAMEL(17-49,167-189) (opt7)
gggagagucccgcagucggcguccagcggcucugcuuguucgugugugugucguugcaggccuuauucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaauaugauucggcaccccagucuccugccagaccugccgcucgaagcauggcccgccacugauaaaaccaagcgcgaggaaguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6898 - RNA, 810 nt, Artificial Sequence
  mRNA product Design5 comprising derived and/or modified sequence from Sus scrofa__P45561-2__SsAMELX-001-2 (opt7)
gggagagucccgcagucggcguccagcggcucugcuuguucgugugugugucguugcaggccuuauucaagcuuaccaugggcaccuggauccuguucgccugccuccugggggcagccuuuagcaugcccuugccaccgcaccccggucauccaggcuacauuaacuucuccuauaucaggcaccccuacaccaguuauggguacgagccaaugggcgguuggcugcaucaccagauuauccccguggucagccaacagacuccacagucccaugcgcuccagccgcaccaccauauucccauggugccagcccaacagcccgggaucccacagcagcccaugaugccgcugcccggccaacacaguaugacgccaacucagcaucaccagcccaauuugccacugcccgcacagcaaccauuucagccgcagcccguacaaccacagccccaccagccacuccagccccaaagcccgaugcauccaauccagccccugcugccccagccaccccucccaccgauguucuccaugcagagccuguugcccgaccugccacucgaagccuggcccgcaaccgauaagaccaaacgggaggaaguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6899 - RNA, 846 nt, Artificial Sequence
  mRNA product Design5 comprising derived and/or modified sequence from Sus scrofa__NP_998965.1__SsAMELX-001-3 (opt7)
gggagagucccgcagucggcguccagcggcucugcuuguucgugugugugucguugcaggccuuauucaagcuuaccaugggcaccuggaucuucuuugccugccugcucggggcaagccuggccaugcccuugccaccgcaccccggucauccaggcuacauuaacuucuccuaugaggugcugacuccccucaagugguaccagaauaugaucaggcacccauauaccaguuacggguaugaacccaugggcgguuggcugcaucaccaaauuaucccagucgugagccagcagacgccgcagucccaugcguugcaaccccaccaccauauuccaaugguacccgcccagcagccagggaucccccagcaaccgaugaugccccugccaggccagcacaguaugacucccacccagcaucaccagccaaaccucccccugccagcacaacagccguuucagccccaaccagugcagccccagccacaccagccccugcaaccgcagagcccaaugcaucccauccagccccuccugccacagcccccauugccgcccauguucuccaugcaaagccugcucccagaccugccccuggaggccuggccagcaaccgauaaaacuaagcgggaagaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6900 - RNA, 495 nt, Artificial Sequence
  mRNA product Design5 comprising derived and/or modified sequence from Sus scrofa__K7GPB2__SsAMELX-002 (opt7)
gggagagucccgcagucggcguccagcggcucugcuuguucgugugugugucguugcaggccuuauucaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccaagucuguugcccgaccugccacucgaagcguggccggccaccgauaaaacgaagcgggaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6901 - RNA, 888 nt, Artificial Sequence
  mRNA product Design5 comprising derived and/or modified sequence from Sus scrofa__K7GLD0__SsAMELX-003 (opt7)
gggagagucccgcagucggcguccagcggcucugcuuguucgugugugugucguugcaggccuuauucaagcuuaccaugggcaccuggauccuguucgccugccuccugggggcagccuuuagcaugcccuugccaccgcaccccggucauccaggcuacauuaacuucuccuaugaggaccuguaccucgaagcgaucaggauugaucggacugccuuugugcugacccccuugaagugguaucagaauaugauccgccacccauacacgaguuauggguacgagcccaugggcgguuggcugcaucaccaaauuaucccagucgugagccagcagacuccgcagucccaugcacuccaaccccaccaccauaucccaaugguacccgcccagcagccagggauuccccagcaaccgaugaugccccugccaggccagcacaguaugacccccacccagcaucaccagccaaaccugccccucccagcacaacagccguuccagccccaaccagugcagccccagccacaccagccccugcaaccgcagagcccaaugcaucccauccagcccuugcugccacagcccccacucccgcccauguuuuccaugcaaagccugcugccagacuugccccucgaagccuggccagcgacugauaaaaccaagagggaggaagucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6902 - RNA, 774 nt, Artificial Sequence
  mRNA product Design5 comprising derived and/or modified sequence from Sus scrofa__K7GPE9__SsAMELX-004 (opt7)
gggagagucccgcagucggcguccagcggcucugcuuguucgugugugugucguugcaggccuuauucaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccaacgccccaaagucaugcgcugcagccacaccaucacauuccgaugguccccgcccagcagccagggaucccccaacagccaaugaugcccuugccgggccagcacagcaugacccccacucagcaucaccaaccaaaccugccccucccagcacagcagcccuuucagccacaaccggugcagccccagccacaucaaccccugcagccacagucccccaugcacccgauucagccacugcucccccaacccccacugcccccaauguucaguaugcagagcuugcugccggaccucccccuggaagccuggccagcaaccgauaaaaccaagcgggaggaaguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6903 - RNA, 798 nt, Artificial Sequence
  mRNA product Design5 comprising derived and/or modified sequence from Sus scrofa__J9JIM4__SsAMELX-201 (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucacuccccugaagugguaccagaauaugauuaggcacccauauaccuccuacgguuaugaacccaugggcgggugguugcaucaccaaaucauuccagucgugagucagcagaccccgcagagccaugcccugcaaccccaccaccauaucccaaugguacccgcacagcagccaggcauuccccagcaaccgaugaugccccucccaggucagcacuccaugacgcccacucagcaucaccagccaaaccugcccuugccagcccaacagccguuucagccccaaccagugcagccccagccacaccagccccugcaaccgcagaguccaaugcaucccauccagccccuccugccacagcccccacugccgcccauguucagcaugcaaucccuccugccagacuugccccuggaggcguggccagccaccgauaaaaccaagcgggaagaggucgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6904 - RNA, 3237 nt, Artificial Sequence
  mRNA product Design5 comprising derived and/or modified sequence from Homo sapiens__NP_006120.1__HsBMP1 (opt7)
gggagagucccgcagucggcguccagcggcucugcuuguucgugugugugucguugcaggccuuauucaagcuuaccaugcccggcguggccaggcugccacuccuguuggggcugcuccuguugccgcggcccggucgcccacuggaccucgcagauuacaccuaugaccuggccgaggaagaugacagcgagccccugaacuacaaggauccaugcaaagcggccgcauuccucggcgacaucgcccuggaugaagaggacuugagggcauuucagguccaacaggccguggaucugcggcgccacacugcgaggaaguccaguauuaaagccgcaguacccgggaauaccagcacgccauccugucagaguacuaacggccagccgcaacggggugccugcgggcgcuggaggggccggagccgcuccaggcgggccgcaaccagccgccccgaaaggguguggccagacggcgucauccccuucgugauuggggguaauuuuaccggcucccagcgggccguguuccgccaggcgaugaggcauugggagaagcacacuugugucaccuuucucgagcggacggaugaagacaguuauaucguguucacuuaccgcccaugcggguguugcagcuauguaggcaggcggggugggggcccccaggccauuuccaucggcaaaaacugugauaaguuugggaucgugguccaugagcugggucacguggugggcuucuggcaugaacacaccaggccggaccgcgaccggcacgucagcauugugagggagaauauccaacccgggcaggaguacaacuuucugaagauggaaccacaggagguagaaaguuugggcgagacuuaugauuucgacuccauuaugcauuacgcacgcaauaccuuuagccgggguaucuuccucgauaccauugugcccaaauacgaagucaacggcgugaagccacccaucgggcagaggacgcgccuguccaaaggcgacauugcccaagcacggaagcuguauaaaugcccagccuguggggagacucuccaggauaguaccgguaauuucagcuccccggaguaccccaacggcuauagcgcccacaugcauugcguguggaggaucagugucacuccaggggaaaagaucauucugaauuuuaccuccuuggaccuguaccggagccgccucugcugguaugauuacguggagguaagggacggcuucuggcggaaagcgccccugcgcgguagguuuuguggcaguaagcugccagaacccaucguguccaccgauagccgguugugggucgaguuccgcagcuccaguaacuggguggggaagggcuuuuucgcagucuaugaagccauuugcgggggcgacgugaaaaaggauuacggucacauccagagcccgaauuacccagacgacuauaggcccuccaaaguguguauuuggcggauccaaguaagcgagggguuucacgugggccucacuuuccagaguuuugagaucgaaaggcaugauuccugcgccuacgacuaucuggagguccgcgauggucacagcgaauccaguacgcugauuggccgguacuguggguaugagaagcccgacgauaucaaaagcaccuccagcaggcucuggcugaaguucgugagugacggcuccauuaacaaggcaggguuugccgucaauuucuuuaaagaaguggaugagugcagccgcccaaaccggggcgguugugagcagaggugcuugaacacucugggguccuacaaguguaguugcgaccccggcuaugaacucgcgccagauaaacgccggugcgaggccgcauguggcggguuccugaccaagcugaaugguagcaucaccuccccgggcuggcccaaagaauacccacccaacaagaauugcauuuggcaguugguggccccaacucaauacaggaucagccuccaguucgacuuuuucgagacggaggggaacgauguauguaaguaugacuuuguggaaguccgcaguggccugaccgcagauuccaaacugcaugguaaguucugcgggagcgagaaacccgaagugaucacuucccaguacaauaacaugcgggucgaguuuaagagcgacaauaccgugaguaaaaagggcuucaaggcccacuuuuucagcgacaaagaugaauguuccaaggacaacggcgggugccagcaagauugugugaauaccuuugguaguuaugagugccaguguaggagcggcuucguacuccaugacaacaaacacgauugcaaggaggccgggugugaccacaaagucacuuccacgagcggcaccauuacuuccccgaauuggccagauaaguaccccaguaaaaaggaaugcaccugggcaaucagcuccacuccaggucaucgcgugaagcugaccuuuauggagauggacauugaaagucagcccgagugcgccuaugaucacuuggaaguguucgacgggcgggaugcgaaagccccgguccugggcagguucuguggcagcaagaaacccgagccagugcucgcaacggggucccgcauguuucugcgguucuacagcgacaacagugugcagaggaaggguuuucaagccucccaugccaccgagugcggcgggcagguacgcgcagacgucaaaacuaaggaucuguauagccacgcgcaguucggcgacaauaacuaccccggugggguggauugugaaugggugaucgucgccgaggaaggcuacggcguggaguugguauuucagaccuucgaaguggaggaggaaacugacugcggguaugauuacauggagcuguuugacgguuaugauuccaccgcaccaaggcucggccgguacugugggagcggucccccagaagaggucuauagugccggcgacuccgugcuggugaaguuccacagcgaugacacgauuaccaaaaagggcuuucaucucagguacaccaguacuaaauuccaagauacucugcacucccgcaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6905 - RNA, 1467 nt, Artificial Sequence
  mRNA product Design5 comprising derived and/or modified sequence from Homo sapiens__NP_001191.1__HsBMP2 (opt7)
gggagagucccgcagucggcguccagcggcucugcuuguucgugugugugucguugcaggccuuauucaagcuuaccaugguggccggcaccaggugccugcucgcacuguugcugccccagguccuccuggguggggccgcgggcuuggugccagagcuggggcggcgcaaguucgccgcagccagcuccggcaggccgaguagccaacccuccgacgaaguacucagugaguuugaacugcggcugcucagcauguucggucugaaacagcgcccaacucccuccagggaugcaguggucccacccuacauguuggaccuguaucggcgccacagcgggcagccaggcuccccggcccccgaucauaggcucgagcgggcggccagucgcgcaaacaccgugaggagcuuucaccaugaagagucccuggaggaacugccagagacgagcggcaagacuacccggcgcuucuuuuucaauuugaguuccauccccaccgaagaguuuauuacuagcgccgagcuccagguguucagggaacaaaugcaggacgcccuggggaacaauuccaguuuucaccaucggaucaacauuuacgagaucauuaaaccagcaaccgccaauagcaaguuccccgucacgcgccugcucgauacuaggcuggugaaccagaaugcgucccggugggaauccuuugacguaaccccggccgugaugcgcuggacugcacagggucacgccaaccacggcuucgucguggagguggcacauuuggaagagaaacaaggggucaguaagaggcacgugcggaucuccaggagccugcaucaggaugagcacaguuggucccagauccgcccccuccugguaaccuucggccacgacgguaaggggcauccacugcacaaacgggaaaagaggcaggccaaacauaagcaacgcaaacggcucaagagcagcuguaaaaggcaccccuuguauguggauuuuuccgacgucggcuggaaugauuggauuguggccccacccggcuaccaugcguucuauugccacggggaguguccauuuccgcuggcagaccaccugaacaguaccaaucaugccaucgugcagacgcucgucaacagcgugaauagcaagauucccaaggccugcuguguaccaacugaacugagcgcaaucaguauguuguaccuggaugagaacgaaaaagugguccucaagaauuaucaggacaugguggucgaggguugcggcugucgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6906 - RNA, 1503 nt, Artificial Sequence
  mRNA product Design5 comprising derived and/or modified sequence from Homo sapiens__NP_001193.2__HsBMP4 (opt7)
gggagagucccgcagucggcguccagcggcucugcuuguucgugugugugucguugcaggccuuauucaagcuuaccaugauccccggcaacaggaugcugauggugguccuccugugccagguguugcucgggggugccagccacgcaucccugauuccagagaccggcaagaaaaagguagccgaaauccaagggcaugcgggcggucggcgcagugggcagagccacgagcuguugagggacuucgaagccacucugcuccagauguuuggccugcggcgcaggccgcagcccuccaaaagugcagugauuccagauuacaugcgggaccuguaucgccuccaaagcggcgaggaagaggaggaacagauccauuccaccgggcuggaguaccccgaaaggccagccagccgggcaaauacgguccgcuccuuccaccaugaggagcacuuggaaaacauucccgguaccagugagaauagcgccuuuagguuccuguuuaaccucuccagcaucccagaaaaugaggugaucaguuccgcggaacugcggcuguuccgcgaacagguggaucagggcccggacugggagaggggguuucaccggauuaacaucuaugaggucaugaagcccccagccgaggugguacccggccauuugauuacucgccuccuggauaccaggcuggugcaccauaaugucacucggugggaaaccuucgacgugagcccagcagugcuccgcuggacgagggagaaacaacccaacuacggucuggccaucgaagucacucacuugcaccagacccggacucaucaggggcagcacgugaggauuucccgcagucugccgcaaggcagcggcaauugggcccagcuccggccccugcugguaaccuuugggcaugaugguaggggccacgcauugacccgccggaggcgcgccaagcgguccccaaagcaucacagccagagggcgcggaaaaagaacaaaaauugucgcaggcacagucucuauguggacuucuccgaugucggguggaacgacuggaucguggcacccccaggcuaccaagccuuuuauugccauggugauugucccuucccacuggccgaccaccugaauagcacgaaccaugcaauugugcagacucucgucaauagugugaacuccagcaucccgaaggccugcuguguacccaccgagcugagcgccaucuccauguuguaccuggaugaguacgacaaagugguccucaagaacuaucaggaaaugguggucgagggcugcgggugucggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6907 - RNA, 1818 nt, Artificial Sequence
  mRNA product Design5 comprising derived and/or modified sequence from Homo sapiens__NP_001709.1__HsBMP6 (opt7)
gggagagucccgcagucggcguccagcggcucugcuuguucgugugugugucguugcaggccuuauucaagcuuaccaugcccggccuggggaggcgggcccaguggcucugcuggugguggggucuguuguguagcugcuguggcccaccgccccugcgcccaccccucccagcagccgcggccgcagccgcagggggccaacuguugggugacgggggcucccccggcaggaccgagcagccaccgcccaguccacagagcuccaguggguuccuguaccggcgccucaagacucaggagaaaagggaaaugcaaaaggaaauccugagcgugcugggucucccccaccggccacgcccccugcauggcuugcagcagccgcagcccccagcccugaggcaacaggaggaacagcagcaacagcagcaacucccccgcggggagccacccccaggccggcugaaauccgcgccgcuguuuauguuggaucucuauaacgcccugagcgcagacaaugaugaggacggugccuccgaaggggagaggcagcagaguuggccccacgaagccgcaagcuccagccagcggcgccaaccacccccaggcgccgcgcauccccugaacaggaagagucuccuggccccgggcuccgggagcgguggcgcauccccauugaccagugcccaggauagcgcauuccugaaugacgccgauauggucauguccuuugugaaccucguagaguacgacaaagaguucagcccccggcagcgccaccauaaggaauuuaaguucaaucugagucagauucccgagggggaaguggucacggccgcggaguuuaggaucuauaaagauugcgugaugggcuccuucaagaaccaaacuuuucugauuagcaucuaccagguguugcaggaacaccagcaccgggacagugaucucuuccugcuggacacccgcgucgugugggcauccgaggaggguuggcucgaauuugauauuaccgccacuagcaaucuguggguagugaccccacaacauaacaugggcuugcagcugagcgucgugacgagggacggggugcacguccauccccgggccgcaggccucguggggagggacgguccauaugauaaacagccguucaugguagccuucuuuaagguguccgagguccacgugcgcacuacccggagugcgagcuccaggcgccggcagcaaagcaggaaucgcaguacucagucccaggacguggcccgggucagcuccgcaagugauuacaacagcuccgaacugaaaaccgccuguaggaagcacgagcuguaugugagcuuccaagacuugggcuggcaggauuggaucaucgcacccaaaggguacgccgccaauuacugcgacggcgaauguaguuuuccacucaacgcacauaugaaugccaccaaccacgcgauuguacagacgcuggugcaucugaugaaucccgaguaugucccaaagcccugcugugccccgacuaagcucaacgcaaucuccgugcuguacuucgaugacaacagcaaugucauuuugaaaaaguaucggaacaugguggugcgcgccugcgguugccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6908 - RNA, 1572 nt, Artificial Sequence
  mRNA product Design5 comprising derived and/or modified sequence from Homo sapiens__NP_001710.1__HsBMP7 (opt7)
gggagagucccgcagucggcguccagcggcucugcuuguucgugugugugucguugcaggccuuauucaagcuuaccaugcacgugaggagccugcgggccgcagcgccccauuccuucgucgcccucugggccccacuguuuuugcugcgcagugcacucgccgacuucagccuggauaacgaggugcacuccaguuuuauccauaggcgguugcgcagccaggaaaggcgggagaugcaacgcgaaauucuguccauccucggccugccgcacaggccccggccacaucugcaggggaagcacaauagcgcacccauguucaugcucgaccuguacaacgccauggcgguagaggaagguggcgggccaggcggucagggguuuuccuaucccuacaaagccguguucaguacccagggcccaccguuggcaagccugcaagauucccacuuucucacugacgccgauauggucaugagcuucgugaaucugguggagcaugacaaggaguuuuuccacccccgcuaucaucacagggaauuucgguucgaucugaguaaaauuccagagggcgaagccgucaccgcagccgaguuccgcaucuacaaggacuauauuagggagcgguuugauaacgaaacguuccgcaucuccguguaccagguauugcaggagcaccucgggagggaaagcgaccuguuucugcucgauucccggacucugugggcgagugaggaagguugguugguguucgacaucaccgccaccagcaaucauugggucgugaacccccgccacaaucugggccuccagcuguccguggagacucuggaugggcaaagcauuaacccaaaauuggcaggccucaucgguaggcaugggccccagaauaagcagccguuuauggucgccuucuuuaaggcaaccgaggugcacuuccggaguauuagguccacgggcagcaaacagcgcagucaaaaccgguccaagacucccaaaaaucaggaagcccugaggauggccaacguagcggagaauagcagcuccgaccagcgccaagcaugcaagaaacaugaacuguaugugaguuuucgggaccucggcuggcaggauuggaucauugccccagagggguacgccgcauacuauugugaaggugagugcgccuucccccugaacagcuacaugaaugcgaccaaccacgccaucguccagacuuuggugcacuuuauuaacccagagaccgugcccaagccauguugcgcaccgacccagcugaaugccaucuccguccucuauuucgacgauagcaguaacgugauccugaaaaaguacaggaauaugguagugcgcgcauguggcugccauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6909 - RNA, 576 nt, Artificial Sequence
  mRNA product Design5 comprising derived and/or modified sequence from Homo sapiens__NP_006264.2__HsCCL7 (opt7)
gggagagucccgcagucggcguccagcggcucugcuuguucgugugugugucguugcaggccuuauucaagcuuaccaugaaggccagcgcagcccugcucugccuguugcugaccgcggccgcauucaguccccagggccucgcccaaccaguggggaucaacacuuccaccacguguugcuacagguuuauuaauaaaaagaucccgaaacagcggcuggagagcuaucgcaggacuaccuccagucacuguccccgggaagcagucauuuucaagaccaaauuggacaaggagaucugcgccgauccaacucagaagugggugcaggacuuuaugaaacaucuggauaagaaaacccaaacgcccaagcucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6910 - RNA, 3900 nt, Artificial Sequence
  mRNA product Design5 comprising derived and/or modified sequence from Homo sapiens__NP_001954.2__HsEGF (opt7)
gggagagucccgcagucggcguccagcggcucugcuuguucgugugugugucguugcaggccuuauucaagcuuaccaugcugcucacccugaucauuuugcugcccguggucagcaaguucuccuuugugagucucagcgccccacagcacugguccugcccggagggcacucuggcagggaacgguaauaguaccuguguaggccccgccccauucuugaucuuuagccaugggaacuccauuuucaggaucgacacggaaggcacuaauuacgagcaacugguggucgacgcgggugugagcgugauuauggacuuucacuauaacgaaaaacggaucuacugggucgaucucgagcgccagcugcugcagaggguguuccucaaugggucccggcaggaacgcguaugcaacaucgagaagaaugugaguggcauggccauuaacuggaucaaugaggaagucauuuggagcaaccaacaggagggcaucauuaccgugaccgacaugaaagggaauaacucccauauccuguugagcgcacugaaguaucccgccaauguggcagucgauccaguggaaagguuuauuuucuggaguuccgagguagccgguagccucuaccgggcggaccuggauggcgugggggucaaagcccuguuggagacuuccgaaaagaucaccgcagugagucucgacgugcuggauaagcgccuguuuuggauccaguauaacagggagggcagcaauucccucauuuguagcugcgacuacgauggugggaguguccacaucuccaaacaucccacgcagcacaaccuguucgccaugagcuuguuuggcgaccggauuuucuauaguacuuggaagaugaaaaccaucuggauugccaacaagcacacuggcaaagauauggugcgcaucaaucugcauuccagcuucguaccacucggggaacugaaggugguccacccgcuggcacaacccaaagccgaggacgacaccugggaaccagagcagaaguuguguaagcucaggaaagguaacugcagcuccaccguguguggccaggaucugcagagucaucugugcaugugugcggagggguacgcccucagccgggaccgcaaguacugcgaagaugucaaugagugcgcauuuuggaaccacggcuguacgcuggguugcaaaaauacucccggcuccuauuacuguaccugcccagugggguucguguugcugcccgacggcaagaggugucaccaacucguaagcugcccgcggaacgugagugaauguucccaugauugcguccugacuagcgaggggccccuguguuuuugcccagaagguuccguguuggagcgcgacggcaaaaccugcaguggguguagcucccccgauaauggcgguugcagccagcucugugucccacugagucccguguccugggagugcgacuguuucccaggcuaugaucugcagcucgacgaaaagagcugcgccgcauccgggccgcaacccuuucuguuguucgccaacagucaggauaucaggcacaugcauuuugacggcaccgacuacgggacucugcucagccagcagaugggcaugguguaugcccuggaucacgacccaguagagaauaagauuuacuucgcgcauacggcacugaaauggaucgaacgggccaacauggaugguucccaacgcgagagguugauugaagaggggguggacguccccgagggccuggccguggauuggaucggucggagguuuuauuggaccgaccgcggcaagagccucauugggcggagugaucugaauggcaaaagguccaagaucaucacuaaagaaaacauuagccagccacgcgggaucgcaguccaccccauggccaagcggcuguucuggaccgacaccggcauuaauccgaggaucgaguccagcagucuccaggguuuggggcgccuggugauugcgagcuccgaucucaucuggccaaguggcauuacuaucgacuuucugacggauaagcuguacuggugugacgccaaacagagcgugaucgaaauggcaaacuuggauggcuccaagcggaggcggcugacccaaaaugacguagggcaccccuucgccgucgcaguguuugaggacuacgugugguucagcgauugggccaugcccuccgucaugcgcgugaacaaaaggacugguaaggaccgggugcgccuccagggcaguaugcugaaaccaagcucccucguagucgugcauccccuggccaagccaggggcagauccgugcuuguaucagaacggcgguugugagcacauuugcaagaaaaggcuggggaccgccugguguaguugccgggaaggcuucaugaaggcgagcgacggcaaaaccugccuggcccucgaugggcaucagcuguuggccgguggcgagguggaccugaagaaucaagucacuccccucgauauccuguccaaaacgcgcgugagcgaagacaacauuaccgagagucagcacaugcucguagcagaaaucaugguguccgaucaggacgauugugccccagucgggugcagcauguacgcaagguguauuuccgagggcgaggacgcgacuugccagugucugaaggguuuugccggggacggcaaauugugcagcgauaucgacgaaugugagaugggcgugcccgugugcccacccgcaaguuccaaguguaucaauaccgaaggggguuaugucugccggugcagcgagggcuaccaaggggauggcauucacugucuggacaucgaugaaugccagcugggugagcauaguuguggggagaacgccuccugcacuaauaccgaaggcggcuauacguguaugugcgccgggaggcucagcgagccgggucugauuuguccagacuccacucccccaccccacuugcgcgaagaugaccaucacuacagcgugcggaacagugauagcgagugcccgcugucccaugacggcuauugucuccacgaugggguaugcauguacaucgaagcacuggacaaguacgccugcaauuguguggucggcuauauuggugagaggugccaguaccgcgaucugaaauggugggagcuccggcacgcgggccaugggcaacagcagaaggugaucguggucgccguguguguagugguccuggugauguugcugcuccugaguuuguggggcgcacacuauuacaggacccagaaacugcucagcaagaaccccaaaaauccauaugaagaguccagccgcgacgugcgguccaggcgccccgccgacaccgaagaugggaugaguagcugcccacaacccugguucgucgugaucaaggagcaucaggaccugaagaacgguggccagccaguagccggggaggauggccaggcagccgacgguuccaugcaaccgacuagcuggcggcaggaaccccagcuguguggcauggggaccgagcagggcugcuggauuccagugaguuccgauaaagggagcuguccccaagucauggaaagguccuuucacaugccaaguuacgguacgcagacccucgagggcgggguggaaaagccccacagccuguuguccgcgaauccgcuguggcagcaacgcgcccucgaucccccacaucagauggagcugacucagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6911 - RNA, 786 nt, Artificial Sequence
  mRNA product Design5 comprising derived and/or modified sequence from Homo sapiens__NP_001423.1__HsEREG (opt7)
gggagagucccgcagucggcguccagcggcucugcuuguucgugugugugucguugcaggccuuauucaagcuuaccaugaccgccggcaggcggauggagaugcugugcgcagggcgcgugcccgcccuccuguugugccuggguuuccaccuccugcaggcggucuugagcacuaccgugaucccauccugcauuccgggcgaaaguagcgacaacuguacggcccugguacaaacugaggauaaucccaggguggcacaggucuccaucaccaagugcaguagcgacaugaacggguacugucuccauggccagugcauuuaucugguggauaugucccagaauuacugucggugcgaaguggguuauaccgggguccgcugugagcacuuuuuccugacugugcaucaaccacucagcaaagaauacguagcccugaccgugaucuugauuauccuguuucucaucacggucgugggcuccacuuauuacuucuguaggugguaucggaaccgcaagaguaaagagcccaagaaagaguacgaaagggugaccagcggcgacccagagcugccccaggucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6912 - RNA, 744 nt, Artificial Sequence
  mRNA product Design5 comprising derived and/or modified sequence from Homo sapiens__NP_000791.1__HsFGF1 (opt7)
gggagagucccgcagucggcguccagcggcucugcuuguucgugugugugucguugcaggccuuauucaagcuuaccauggccgagggcgaaaucaccacuuucaccgcacugacggagaaguuuaaccugcccccagggaauuacaaaaagccgaaacucuuguauugcagcaacgguggccacuuccugaggauucuccccgacgggacuguggauggcacccgggaccgcuccgaucagcauauccaacugcaguugagugccgaaagcgucggugagguguacauuaaguccaccgaaacugggcaguaucuggcgauggacaccgauggccuccuguacggcagucagacgccaaaugaggagugucuguuucucgaaaggcuggaggaaaaccacuauaauacuuacaucagcaaaaagcaugccgagaagaacugguucguaggguugaaaaagaaugguuccugcaaacggggcccccgcacccacuaugggcaaaaggcaauucuguuucucccacugcccgugagcuccgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6913 - RNA, 1143 nt, Artificial Sequence
  mRNA product Design5 comprising derived and/or modified sequence from Homo sapiens__NP_001997.5__HsFGF2 (opt7)
gggagagucccgcagucggcguccagcggcucugcuuguucgugugugugucguugcaggccuuauucaagcuuaccauggugggcgucggggguggcgacguggaggauguaacccccaggccagggggcugccagaucagcggucgcggggcccggggcuguaacggcauuccgggggcagccgcgugggaagccgcacugcccaggcggcgcccaaggcggcaccccuccgugaauccacgcaguagggccgcagguagcccccggacucgcggcaggcggaccgaggaacgcccauccgggaguaggcucggcgaccggggucgcgggagggcccugccgggcggccgguugggugggcgcggcagggggcgggcgcccgagagggucggcggucgcggccgggggaggggcacggccgcaccacgcgccgcccccgcagcccgggggagcaggccaggucccgcgggcacuauggccgcaggguccaucaccacccugccggcccuccccgaagauggcgguagcggcgcauucccacccgggcauuuuaaggacccaaaacgccuguacugcaagaacggcggguucuuuuugcggauucaccccgauggcaggguggacggugugcgggagaaauccgauccacauaucaagcugcaacuccaggccgaggaacgcggggucgugaguauuaaaggcguaugugccaauagguaucuggcgaugaaggaggacggucggcugcucgcaagcaagugcgugacugaugaauguuucuuuuucgagcgccuggaguccaacaauuacaacaccuauaggagccggaaauacacgaguugguaugucgccuugaagcgcacuggccaguacaaacugggguccaagaccggcccggggcagaaagccauccucuuucugcccaugagcgcaaaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6914 - RNA, 861 nt, Artificial Sequence
  mRNA product Design5 comprising derived and/or modified sequence from Homo sapiens__NP_002000.1__HsFGF7 (opt7)
gggagagucccgcagucggcguccagcggcucugcuuguucgugugugugucguugcaggccuuauucaagcuuaccaugcacaaguggauccugaccuggauucuccccacucuguuguacaggagcugcuuccauaucauuugucuggugggcaccaucucccucgccugcaacgacaugacgccagagcagauggcaacuaaugucaacuguaguagcccggaacggcacacccgcuccuaugauuacauggaagggggugacauuagggugcggcgccuguuuugcaggacccaaugguauuugcggaucgauaaacgcggcaagguaaaagggacucaggagaugaagaauaacuacaauaucauggagauuaggaccguggccgucggcaucguggcgauuaaagguguggaaagugaguucuaucuggccaugaacaaggaggggaagcucuacgccaaaaaggaauguaaugaggacugcaacuuuaaagaacugauccuggagaaucauuauaacacguacgcaagcgcaaaguggacucacaauggcggcgagauguucgucgcccucaaccagaaagggauucccgugcgggguaagaaaaccaagaaggaacagaaaacugcgcauuuucugccaauggccaucaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6915 - RNA, 903 nt, Artificial Sequence
  mRNA product Design5 comprising derived and/or modified sequence from Homo sapiens__NP_001936.1__HsHBEGF (opt7)
gggagagucccgcagucggcguccagcggcucugcuuguucgugugugugucguugcaggccuuauucaagcuuaccaugaagcugcuccccagcgugguccugaaauuguuccuggccgcagugcucuccgcccugguaaccggcgagaguuuggaaaggcugcggcgcgggcucgcggccgguacuagcaacccagacccgcccaccguguccacggaucagcugcugccacucggcgggggcagggaccggaagguccgcgaucugcaagaggcagacuuggaucugcucagggugacucugaguagcaaaccccaggcccuggcaaccccaaauaaggaggaacacgguaaacggaagaagaaagggaagggcuugggcaaaaagcgcgaccccugccucaggaaauacaaggauuuuuguauccauggggaaugcaaauaugugaaggagcugcgggccccauccuguauuugccacccggguuaccauggcgagcgcugucacgggcugagccuccccgucgaaaacaggcuguauaccuacgaccauacuaccaucuuggcggugguagccgugguccuguccagugugugccuccuggugauugucggccuguugauguuccgguaucaccgcagggguggguacgauguggagaaugaagagaagguaaaacucggcaugacgaacagccacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6916 - RNA, 2463 nt, Artificial Sequence
  mRNA product Design5 comprising derived and/or modified sequence from Homo sapiens__NP_000592.3__HsHGF (opt7)
gggagagucccgcagucggcguccagcggcucugcuuguucgugugugugucguugcaggccuuauucaagcuuaccaugugggugaccaagcugcuccccgcccuguugcugcagcacguccuccugcauuugcugcuccugccaaucgcaauuccguacgccgagggccaaaggaaacggcgcaacacuauccacgaauuuaagaaaagcgcgaagaccacgcugauuaaaaucgaccccgcccucaagauuaagacuaaaaaggugaauaccgcagaucagugcgccaacagguguacccggaauaaagggcugccauucacuugcaaggcauucguauuugacaaagcccgcaagcaguguuugugguuccccuuuaacuccaugaguagcggugugaaaaaggaguucggccaugaauuugaucuguaugagaauaaggacuacaucaggaacugcaucauugggaaaggccgguccuauaaggguaccgucaguaucacgaaaagcgggauuaagugucagccaugguccagcaugaucccccacgaacauuccuuccucccaaguagcuaccgcggcaaagaucugcaagagaauuauugcaggaacccgcggggcgaggaagggggucccugguguuuuacuuccaauccagaggugcgcuacgaagugugcgacauuccccaguguagcgaggucgagugcaugaccugcaacggcgaaaguuauagggggcugauggaucacacugaguccggcaagaucugucagcggugggaccaccagaccccacaucgccacaaguucuugcccgaaagguacccggauaaagguuuugacgauaauuacugccggaaccccgacgggcaaccacgccccugguguuauacccucgauccacauacgaggugggaguacugcgcgauuaagacuugugccgacaauaccaugaacgacacugaugugccccuggaaaccaccgagugcauccagggccagggcgagggguaucgggguacuguaaauacgaucuggaacggcauuccaugucagcgcugggacagccaauacccgcacgaacacgauaugacccccgagaacuucaaaugcaaggaccugagggaaaauuauugucggaacccagauggguccgagagucccuggugcuucacuaccgacccaaauaucagggugggcuacugcagccagauucccaacugugauaugucccauggucaggacugcuaucgcggcaaugggaaaaacuacaugggcaaucucagccaaacccggagugggcugacuuguuccaugugggauaagaacauggaagacuugcacaggcauaucuuuugggagccggaugcaagcaagcugaaugagaacuacugccgcaauccagacgacgaugcccacggucccugguguuauacgggcaacccccucauuccaugggacuacugccccaucagucggugugaaggggauaccacuccaaccaucgucaaucuggaccauccggugauuuccugcgccaaaaccaagcagcugaggguggucaacggcauccccacucgcacgaauauugguuggauggugagcuugcgguauaggaacaaacacaucuguggcgggagccucauuaaggaguccuggguacugaccgcacggcagugcuucccaagucgcgaucugaaagacuacgaagccuggcucggcauccacgaugugcaugggaggggcgacgagaaguguaagcagguccugaacgugagccaauugguguauggucccgaaggguccgaucugguccucaugaaacuggcgcggccagccgugcuggacgauuuuguaagcacuaucgacuugcccaauuacggcugcaccauuccggagaagaccaguugcuccguguaugguuggggcuacacugggcucaucaacuacgauggccugcugcgcgucgcacaccucuauauuauggggaaugagaaauguagccagcaucacaggggcaaggugacgcugaacgaauccgagaucugcgccggugcagagaaaauugggaguggcccaugugaaggcgacuacgggggucccuuggucugcgagcagcacaagaugcggauggugcugggcgugaucguaccagggcgcggcugugccauucccaauaggccggguaucuucgugcgggucgccuauuacgcgaaauggauccauaagauuauccucaccuauaaggugccccagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6917 - RNA, 2202 nt, Artificial Sequence
  mRNA product Design5 comprising derived and/or modified sequence from Homo sapiens__NP_005336.3 __HsHSPA1A (opt7)
gggagagucccgcagucggcguccagcggcucugcuuguucgugugugugucguugcaggccuuauucaagcuuaccauggccaaggcagccgcgaucggcauugaccuggggaccacuuacagcugcgugggugucuuccagcacggcaaaguggagaucauugccaacgaucaagggaauaggaccacgcccuccuauguagcauuuacugacaccgaacggcucaucggcgaugccgcaaagaaccagguggcccugaauccacagaacaccgucuucgacgcgaaacgcuugauugguaggaaguuuggggauccgguggugcagagugacaugaaacauuggcccuuccaagucaucaaugauggcgacaagccaaaggugcagguaagcuacaaaggcgagacuaaggccuuuuaucccgaagagaucuccaguauggugcugaccaaaaugaaggaaauugcagaggccuaccucggguauccagucacgaacgccgugaucacugugcccgcauacuucaaugauagccagcggcaggccaccaaagacgcgggugucauugccggccugaacguguugcgcaucauuaaugagccaacugcagccgcaaucgccuaugggcuggauaggaccggcaagggugaacggaacguacucauuuuugaccucgggggcggcaccuucgauguguccauccugacgaucgacgacgggauuuuugaggucaaagccacugcgggugauacccaccugggcggggaagacuucgauaaucgccuggugaaccauuuuguggaggaguucaagaggaagcacaaaaaggacaucagccaaaauaaacgggcaguccgcagguugcggacugccugugaacgcgccaagaggacccuguccaguagcacccaggcaucccucgagauugauagccuguucgaaggcaucgacuuuuacacuagcauuacgcgggcccgcuucgaggaacugugcuccgauuuguuuaggagcacccucgagccgguggagaaagcgcugcgggacgccaagcuggauaaggcacagauccaugaccucguacugguggguggcuccacucgcauccccaaaguccagaaguugcugcaagauuucuuuaacgggagggaccucaauaaaaguauuaacccagacgaagccguggcauacggcgccgccguccaggcagccauccugaugggggauaagagcgagaacgugcaggaccuguugcuccuggauguggcgccccugucccucggucuggaaaccgccggcgggguaaugaccgcauugauuaaacggaauagcacuaucccaacgaagcaaacccagauuuucacuaccuauagugacaaccagcccggcgugcugauccaggucuacgagggugaaagggccaugaccaaggauaauaaccuccugggccgcuuugagcuguccgggaucccgcccgccccacggggcgugccccaaauugaggucacuuucgacaucgaugcaaaugggauuuugaacgugacggcgaccgacaaaagcacuggcaaggccaauaaaaucaccauuacuaacgauaaggguaggcucaguaaagaagagaucgaacgcauggugcaggaggcagaaaaguauaaggccgaggacgagguacagcgggaaaggguguccgccaaaaaugcacuggagagcuacgccuuuaacaugaagagugcggucgaagaugaggggcugaaaggcaagauuuccgaggccgacaaaaagaaagugcucgauaagugucaggaagucaucaguuggcuggacgcaaauaccuuggccgagaaggacgaguucgaacacaaacgcaaggaacuggagcaagugugcaacccaaucauuagcggucucuaucagggcgccgggggccccgggccaggcgguuuuggggcacagggcccgaaaggcggguccgguagcggccccacgaucgaggaaguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6918 - RNA, 2202 nt, Artificial Sequence; identical to SEQ ID NO: 6917
  mRNA product Design5 comprising derived and/or modified sequence from Homo sapiens__NP_005337.2 __HsHSPA1B (opt7)

SEQ ID NO: 6919 - RNA, 2202 nt, Artificial Sequence
  mRNA product Design5 comprising derived and/or modified sequence from Homo sapiens__NP_005518.3 __HsHSPA1L (opt7)
gggagagucccgcagucggcguccagcggcucugcuuguucgugugugugucguugcaggccuuauucaagcuuaccauggccaccgcaaagggcaucgccauugggaucgaccuggguacuaccuacagcugcgugggcgucuuccagcacgggaaaguggagauuaucgcgaacgaucaaggcaauaggacgacucccuccuauguagccuuuaccgacaccgaacggcucauuggugaugcagccaagaaccagguggcaaugaauccacagaacacugucuucgacgccaaacgccugaucgggaggaaguuuaaugauccgguggugcaggcggacaugaaauuguggcccuuccaagucaucaacgagggcggcaagccaaaggugcugguaaguuacaaaggggaaaauaaggccuuuuaucccgaggaaauuagcuccauggugcucaccaaacugaaggagacggcagaggccuucuugggucauccagucacuaacgccgugaucaccgugcccgcauacuuuaaugauagucagcggcaggccacuaaagacgcgggcgucauugccgggcugaacgugcuccgcaucauuaaugaaccaaccgcagccgcaaucgccuauggccuggauaagggugggcagggcgagaggcacguacugauuuucgaccucggcggggguaccuuugaugugagcauccugacgaucgacgauggcauuuucgaagucaaagccacugcgggggacacccauuugggcggugaggacuuugauaaccggcuggugucccacuucguggaggaguucaagcgcaagcauaaaaaggacaucagccaaaauaaaagggcaguccggcgccucaggacugccugugagcgggccaagcgcacccuguccaguagcacccaggcaaaccuggaaauugauuccuuguacgagggcaucgacuuuuauacuagcauuacgagggcccgguucgaagaacucugcgcggaucuguuucgcgggacccuggagccgguggaaaaagcccucagggacgcaaagauggauaaggccaaaauccacgacaucguacuggugggcgggaguacucggauucccaagguccagcgcuugcugcaggauuacuucaaugguagggaccucaacaaauccaucaacccagaugaggcaguggccuacggcgccgcaguccaagccgcgauucugaugggggacaagagcgaaaaagugcaggaccuguugcuccuggauguggcaccccugucccucggccuggagaccgccgguggcguaaugaccgccuugaucaagcggaauaguacuauuccaacgaagcagacccaaaucuuuacuaccuauagcgacaaccagcccggggugcugauccaggucuacgaaggcgagagggccaugaccaaagauaauaaccuccuggggcgcuucgaccugacuggcauuccgcccgcaccacggggugugccccagaucgaggucacguuugauauugacgcgaaugggaucuugaacgugaccgccacugauaaguccaccggcaaagugaauaagauuacuaucaccaacgacaaagguaggcucagcaaggaagagauugaacgcaugguacuggaugcagagaaguauaaagccgaagacgaggugcaacgggagaagaucgccgccaaaaaugcacuggaaaguuacgcguucaacaugaaguccgucgugagcgaugagggccucaaagggaagaucagugaauccgacaaaaauaagauucuggauaaguguaacgaguugcugagcuggcucgaggucaaucagcuggccgaaaaagacgaguuugaccacaagaggaaagaacuggagcagaugugcaacccaaucauuacgaaguuguaucagggcggguguaccggccccgcaugcgguacuggguacgugccaggccgcccggccaccggccccacuaucgaagagguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6920 - RNA, 2196 nt, Artificial Sequence
  mRNA product Design5 comprising derived and/or modified sequence from Homo sapiens__NP_068814.2 __HsHSPA2 (opt7)
gggagagucccgcagucggcguccagcggcucugcuuguucgugugugugucguugcaggccuuauucaagcuuaccaugagcgccaggggccccgcaaucgggauugaccuggguaccacuuacuccugcgugggcgucuuccagcacgggaagguggagaucauugccaacgaucagggcaaucggaccacgccaaguuauguagcguuuacugacaccgaacgccucaucggugaugccgccaaaaaccagguggcaaugaauccgaccaacacuauuuucgacgcaaagaggcugaucgggcggaaauuugaggaugccaccguccagagcgacaugaagcauuggcccuuccgcgugguguccgaaggcggcaaaccaaagguccagguggaguacaagggggaaacgaaaaccuuuuuccccgaggagaucaguagcaugguauugacuaagaugaaagaaauugcggaggccuaucuggguggcaaggugcacuccgcagucaucacugugccagccuacuuuaaugauagccaaaggcaggccaccaaagacgcagggaccauuacgggccucaacgugcugcggaucauuaaugaacccacugccgcggccaucgcauaugguuuggauaagaaagggugugccggcggcgagaagaacguccugauuuucgaccucggggguggcaccuuugauguguccauccugacuaucgaggacgggauuuucgaaguaaagaguaccgcaggcgauacccaucuggguggcgaggacuuugacaaucgcauggugagccaccucgccgaagaguucaaaaggaagcauaaaaaggauaucgggccaaacaaacgggccguccgcaggcugcggacugcgugcgaacgcgcaaagaggacguuguccagcaguacccaggccuccauugagaucgacagccuguacgagggcguggauuucuauacuuccauuacccgggcccgcuuugaggaacucaaugcagaccuguucagggggacccuggaaccgguggagaaggccuugcgggaugcgaaacucgacaagggucagauccaagaaaucguccuggugggcgggaguacucgcauucccaaaauccagaagcugcuccaggacuuuuucaacggcaaagagcugaauaagagcauuaacccagaugaggccguagcauacggugccgcagugcaggccgccaucuugauuggcgauaaguccgaaaauguccaagaccugcuccugcuggaugugacgcccuugagccucgggaucgagaccgcaggcggggucaugacuccacugaucaaaaggaacaccaccauucccacuaagcagacgcagaccuuuacuaccuacagugacaaccaauccagcgugcuggugcagguauaugaaggcgagcgggccaugacuaaagacaauaaccuccuggguaaguucgauuugaccgggaucccgcccgcgccaaggggcgugccccagauugaagucacguuugacaucgaugccaaugguauucugaacgugaccgcagccgacaaaaguacuggcaaggagaauaagaucaccauuacuaacgauaaagggcgccucuccaaggacgauaucgaccggaugguccaggaggccgaaagguacaaaagcgaggaugaagcaaaucgcgaccggguggcggccaagaacgcacuggagagcuauaccuacaauaucaaacaaacgguggaggaugaaaagcugaggggcaaaauuuccgagcaggacaagaacaagaucuuggauaaaugucaggaaguaauuaauuggcucgaccgcaaccagauggccgagaaggacgaauaugagcacaaacaaaaggagcuggaacgggugugcaauccaaucauuaguaaacuguaccaagggggccccggugggggcagcggcggggguggcuccggggccagcggcgguccaaccaucgaggaagucgauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6921 - RNA, 2799 nt, Artificial Sequence
  mRNA product Design5 comprising derived and/or modified sequence from Homo sapiens__NP_002145.3 __HsHSPA4 (opt7)
gggagagucccgcagucggcguccagcggcucugcuuguucgugugugugucguugcaggccuuauucaagcuuaccaugagcguggucggcaucgaccugggguuccaguccugcuacguggccguagcaagggccgguggcauugagaccaucgcgaacgaauauagugaucgguguacucccgccugcauuagcuuugggccaaagaaucgcuccaucggcgcagccgcaaaaagucaagugauuagcaacgccaagaauaccguccaggguuucaaaagguuucacgggcgggcguucuccgacccguuuguggaggccgaaaagagcaaccucgcauacgauaucgugcagcugcccacgggcuugacuggcaucaaagucaccuauauggaggaagaacgcaauuucaccacugaacaggugaccgccaugcugcucuccaagcugaaggaaacggccgagaguguauugaaaaagccaguggucgacuguguggugagcguccccugcuuuuacacugaugcagaaaggcgguccgugauggacgccacccaaauugcggggcugaacugucuccgccugaugaaugagacuaccgccguagcacuggccuaugguaucuacaaacaggaucucccagcacuggaggaaaagcccaggaacguggucuucguggacaugggccauagcgccuaucaggugagugucugcgccuuuaaucgggggaaauugaaggugcuggcgaccgcauucgauacgacucucggcggucgcaaauuugacgagguacuggugaaccacuucugugaagaguucgggaagaaguacaaacuggauauuaaguccaaaaucagggccuugcuccggcugagccaggaaugcgagaagcugaaaaagcucauguccgccaaugcaagugaccugccauugagcauugaguguuuuaugaacgaugucgacguguccggcaccaugaaucgcggcaaguuccuggaaaugugcaacgaccuccuggccagggucgagccgccccugcggagcguguuggaacaaacuaaacucaagaaagaggauaucuacgcgguggaaauuguagggggugccacccgcaucccagcagugaaggagaaaaucaguaaguuuuucggcaaggagcuguccaccacucugaaugccgacgaagcagucacgagggggugcgcccuccagugugccauucugagccccgcauuuaaagugcgggaguucaguaucaccgaugucgugccauaucccauuuccuugcgcuggaacagcccggccgaagagggcagcuccgacugcgaaguguuuaguaagaaccaugcggcccccuucagcaaaguacugacuuuuuacaggaaggagccauucacccucgaggcauauuacuccagcccccaggaucugccauaucccgacccagccaucgcccaguuuagugugcaaaaagucaccccgcaguccgaugguagcuccaguaaggugaaggucaaagugcgggugaauguacacggcauuuucagcgucuccagcgcaagucugguggaagugcauaaguccgaggaaaacgaggagcccauggaaacugaccagaaugcgaaagaggaagagaagaugcaagucgaucaggaggagccacacguggaggaacagcagcaacagacgcccgccgagaacaaagcagaaagcgaggaaauggagaccucccaggccgggaguaaggacaaaaagauggaucagccaccccaagccaagaaagcaaaggugaaaacuagcaccguagacuugccgaucgagaaucagcuccuguggcagaucgacagggaaaugcugaaccucuacauugagaaugaaggcaagaugaucaugcaggauaaacuggagaaggaacgcaacgacgccaagaaugcggucgaggaguauguguacgaaaugcgggauaaauuguccggggaguacgaaaaguuugugagcgaggacgauaggaacaguuucacccugaaacucgaggacacugaaaauuggcuguaugaggauggugaagaccaaccaaagcaggucuacguggauaaacuggccgaguugaagaaccugggccagcccauuaagauccgcuuccaggaauccgaggagcggcccaaacucuuugaggagcuggggaagcaaauucagcaguauaugaaaaucaucagcuccuucaagaauaaagaagaccaauacgaucaccucgacgcagccgauaugacgaagguagagaaaagcaccaacgaagccauggaguggaugaauaacaagcugaacuugcagaauaagcagagucugacuauggacccaguggucaaaagcaaggagauugaagcaaaaaucaaggagcucaccuccacuuguagucccauuaucagcaaaccaaagccgaagguggaacccccaaaagaggagcagaagaacgccgaacaaaauggccccguggacggucagggcgauaacccagggccccaggcggccgagcagggcaccgacacggcagucccguccgauagcgacaaaaagcugccagaaauggauauugacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6922 - RNA, 2796 nt, Artificial Sequence
  mRNA product Design5 comprising derived and/or modified sequence from Homo sapiens__NP_055093.2 __HsHSPA4L (opt7)
gggagagucccgcagucggcguccagcggcucugcuuguucgugugugugucguugcaggccuuauucaagcuuaccaugagcguggucggcaucgaccugggguuccucaacugcuacauugccguggcaagguccgguggcaucgagaccauugccaaugaauauagugaucgguguacucccgcgugcaucagccuggggucccgcaccagggccauuggcaacgcagccaagagucagaucguaacgaaugugcggaacacuauccacgguuuuaaaaaguugcaugggcgcagcuucgacgauccaauuguccaaaccgagaggauccggcugccguacgaacuccagaaaaugcccaauggcuccgcaggcgugaaggugcgcuaucuggaggaagagaggccauuugccauugagcaggucaccgggauguugcuggcgaaacucaaggaaacuagcgagaacgcccugaagaaacccguggcagacuguguaaucuccauuccaaguuucuuuaccgaugccgaacggcgcagcgugauggccgcagcccaggucgcgggucugaauugccucaggcugaugaacgagacgacugccguggcauuggccuacggcaucuauaagcaagaccugcccccacucgaugagaaaccgcggaauguggucuucauugacauggggcacuccgcauaccaggugcugguaugugccuuuaacaagggcaaacugaagguguuggccaccacuuucgaucccuaucucggugggcgcaauuuugacgaagcgcuggucgauuacuucugcgacgaguuuaaaaccaaguacaagaucaacgugaaagaaaauagcagggcacugcuccggcuguaucaggagugugaaaaguugaaaaagcugaugagugccaacgccuccgaucucccacugaauaucgagugcuucaugaacgaccuggacgugagcuccaaaaugaaccgcgcacaguucgagcaauugugugccagucuccuggcgagggucgaacccccacugaaggccgugauggagcaggcaaaucuccagcgggaagauauuagcuccaucgagauuguaggcggcgccacccgcauccccgcagugaaggaacagauuacgaaauuuuuccugaaggacaucagcacuaccuugaacgccgaugaggccgucgcaagggggugcgcccugcaaugcgcgauccucaguccggccuuuaaagugcgggaguucuccauuacugaccugguccccuacagcaucacccugagguggaagaccaguuuugaagaugguuccggcgagugugaaguguucugcaaaaaucauccagcacccuuuagcaaggugauuacuuuccacaagaaagagccauuugaauuggaggccuucuauacgaaccuccaugagguacccuacccagacgcccgcaucgggagcuuuaccauucagaauguguucccgcaguccgauggcgacaguagcaaggucaaagugaagguccgggugaacauccacgguaucuuuuccguggcaagcgcgaguguaauugaaaaacaaaaucuggagggcgaucacuccgacgcccccauggaaacugagaccagcuucaagaacgagaauaaggauaacauggacaaaaugcaaguggaccaggaagaggggcaucagaagugucacgcagaacauaccccagaggaagagaucgaucacacuggcgccaaaacgaaguccgccgucagugacaaacaggauaggcugaaucagacccucaagaaagggaaggugaaguccauugaccugcccauccaguccagcuugugccgccagcugggucaagaucuccugaacaguuauauugagaaugaaggcaaaaugaucaugcaggacaagcuggagaaagaacggaacgaugcaaagaaugccgucgaggaauacguguaugacuucagggaucgcuuggggacuguguacgagaaauuuauuaccccagaggaccuguccaagcucagcgcgguacuggaagauaccgagaacuggcucuacgaagacggcgaggaucagcccaagcaggucuauguggacaaacugcaagaauugaagaaauacggucagccgauccagaugaaguauauggagcacgaggaacggccaaaagcccugaacgaccucggcaagaagauccagcuggugaugaaagucauugaggcauacaggaauaaggaugaacgguaugaccaucuggaucccacugagauggagaaaguggaaaaguguaucuccgacgccaugaguugguugaacagcaaaaugaaugcccaaaacaagcugucccucacgcaggaucccgugguaaaagucagcgagauuguggcaaagaguaaggaacuggacaauuucugcaacccaaucauuuacaaacccaagccaaaagccgaggugccggaagauaagcccaaagcgaauagcgagcacaacgggccaauggacggccagagcgggaccgagacuaaguccgauagcaccaaggacaguagccaacauacuaaauccaguggcgaaauggaggucgauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6923 - RNA, 2241 nt, Artificial Sequence
  mRNA product Design5 comprising derived and/or modified sequence from Homo sapiens__NP_005338.1__HsHSPA5 (opt7)
gggagagucccgcagucggcguccagcggcucugcuuguucgugugugugucguugcaggccuuauucaagcuuaccaugaagcugagccucguggccgcaaugcuguugcugcucuccgccgcgagggccgaggaagaggacaaaaaggaagaugucggcaccgugguagggaucgaccuggguacuaccuacaguugcgugggcgucuucaaaaacgggcggguggagauuaucgcaaaugaucagggcaaccgcauuacgcccagcuauguggccuuuacuccagaaggugagagguugaucggggacgcagccaagaaucaacugaccuccaacccggagaauaccgucuucgaugcgaaacggcucauuggccgcacuuggaacgaccccagugugcagcaggauaucaaguuucugccauucaagguaguggagaaaaagaccaaacccuacauccaggucgacauuggcgggggucaaacgaagacuuuugccccagaagaaaucagcgcaauggugcugaccaaaaugaaggagacugccgaggccuaucucggcaaaaaggugacccacgcagucgugaccguacccgccuacuucaaugaugcgcagaggcaggccacgaaggacgcagggacuauugccggccugaacgugaugcggaucauuaaugaaccaaccgcagccgccaucgcguaugguuuggauaaacgcgagggggaaaagaacauucuggucuuugaccucggcggcgggacuuucgaugugucccugcugaccaucgacaaugguguguuugaggucguggcaaccaacggcgacacucaucucgggggcgaagauuucgaccagaggguaauggagcacuuuaucaaauuguacaagaaaaagacggguaaggaugugcggaaagacaaucgcgccguccaaaagcugaggcgggagguggaaaaagccaagcgcgcacugagcucccagcaucaggccaggauugagaucgaaaguuucuaugagggcgaagauuucagcgagacccucacucgggcgaaauuugaggaacugaacauggacuuguuccgcuccaccaugaagccgguccagaaggugcuggaggauagcgaccucaaaaagagugauauugacgaaaucgugcugguagggggcuccaccaggauucccaaaauccaacagcuggugaaggaguuuuucaaugggaaagaaccaagccgggguaucaaccccgaugaggccgucgcauacggcgccgcagugcaggccggggucuuguccggcgaccaagacacuggugaucucgugcugcuggacguguguccacucacgcugggcauugagaccguagggggcgugaugacuaaguugaucccccgcaacaccgucgugccgaccaagaaaagucagauuuuuagcacugccuccgauaaucagcccacggucaccaucaagguguacgaaggggagaggccacugacuaaagacaaccaccuccugggcaccuucgaucugacugguauucccccagcaccccggggcgugccacagaucgaaguaaccuuugagaucgacgucaaugggauuuugagggugacggccgaggauaaggguaccggcaacaaaaauaagaucacuauuaccaacgaccaaaaucgccucacuccggaagagaucgaacggauggugaacgaugcggagaaauucgccgaagaggacaagaagcugaaagagaggauugauacccgcaaugaacuggagagcuaugcauacagucucaagaaccagaucggggacaaagaaaagcugggcgggaaauuguccagcgaggauaaggaaacgauggagaaggccgucgaggagaaaauugaauggcuggaaagucaucaggacgccgacaucgaggauuuuaaggcgaaaaagaaagaacucgaggagaucgugcagcccauuaucuccaagcuguauggcagcgcagguccacccccaaccggggaagaggacacugccgaaaaggaugagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6924 - RNA, 2208 nt, Artificial Sequence
  mRNA product Design5 comprising derived and/or modified sequence from Homo sapiens__NP_002146.2__HsHSPA6 (opt7)
gggagagucccgcagucggcguccagcggcucugcuuguucgugugugugucguugcaggccuuauucaagcuuaccaugcaggcccccagggagcuggcagugggcaucgaccucgggaccacuuacagcugcgucgguguguuccaacagggccggguagaaauucuggccaacgaucaggggaaucgcaccacgccauccuauguggcguuuacugacaccgagagguuggucggcgaugccgcaaagagucaggccgcacugaacccgcacaauaccguguucgacgccaaacggcucaucggucgcaaguuugcggauacuaccgugcaaagcgacaugaaacauuggcccuucagggucguguccgaagggggcaagccaaaaguacggguguguuaccgcggcgaggauaagacguuuuaucccgaagagauuaguagcaugguccuguccaagaugaaagagacugccgaagcauacuuggggcagccagugaagcacgccgugaucaccguccccgccuauuucaacgacagccagaggcaggcaacuaaagaugccggugcgauugccggccugaaugugcuccggaucaucaacgagccaaccgcagccgcaauugccuacgggcuggaccgcaggggcgccggugaacggaauguacugaucuuugaucucgggggcggcaccuucgacguguccguccugaguauugaugcggggguguuugaggugaaggcaacggccggugacacucauuugggcggggaggacuucgauaaccgccuggucaaucacuuuauggaagaguucaggcggaaacauggcaaggaccucagcgguaacaaacgcgcccugaggcggcugcgcaccgcaugcgaaagggccaagcggacuuuguccagcaguacccaagcgacccucgagaucgauucccuguucgaaggcguggacuuuuauacuagcauuacgagggcccgcuucgaggagcuguguuccgaucucuuucggaguacccuggaaccgguagagaaggcauugagggacgccaaacuggauaaggcacagauccacgacgugguccucgucgggggcagcacucgcauucccaaagugcagaagcugcugcaggauuucuuuaaugggaaagaauugaacaaguccaucaauccagacgaggccguggccuacggugcagccgugcaagcggccguacucaugggcgauaagugcgaaaaagugcaggaccugcugcuccuggacgucgcacccuugagccuggggcucgagaccgccggcggugugaugaccacucugauccagcggaacgccacgauuccaaccaagcaaacucagaccuucaccacuuacagugauaaucagcccggcgucuuuauccagguguaugagggggaaagggcaaugacgaaagacaacaaccuguugggccgcuucgagcucuccgggauuccgcccgcgccacggggcgugccccaaaucgaaguaaccuuugauauugacgccaaugguauccugagcgugacugcaaccgauaggaguacugggaaggccaacaaaaucaccauuacgaaugacaagggccggcuguccaaggaggaagucgagcgcauggugcacgaggccgaacaguacaaagcagaggaugaagcccagagggaccgggucgcggccaagaacagccucgaggcacauguguuccacgugaaagguagccugcaggaggaauccuugcgcgauaagaucccagaggaagacaggcggaaaaugcaagauaagugucgcgagguacuggccuggcucgaacauaaucagcuggccgagaaggaggaauaugagcaccagaaaagggaacuggagcagauuugccggcccaucuuuaguagguuguacggcgggccaggcguccccgggggcagcuccugugguacccaagcacgccagggggacccgagcacuggcccaauuaucgaagagguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6925 - RNA, 1380 nt, Artificial Sequence
  mRNA product Design5 comprising derived and/or modified sequence from Homo sapiens__P48741__HsHSPA7 (opt7)
gggagagucccgcagucggcguccagcggcucugcuuguucgugugugugucguugcaggccuuauucaagcuuaccaugcaggcccccagggagcuggcagugggcaucgaccucgggaccacuuacagcugcgucgguguguuccaacagggccggguagaaauucuggccaacgaucaggggaaucgcaccacgccauccuauguggcguuuacugacaccgagagguuggucggcgaugccgcaaagagucaggccgcacugaacccgcacaauaccguguucgacgccaaacggcucaucggucgcaaguuugcggauacuaccgugcaaagcgacaugaaacauuggcccuuccaggucguguccgaagggggcaagccaaaaguaaggguguguuaccggggcgaggauaagacguuuuaucccgaagagauuaguagcaugguccuguccaagaugaaagagacugccgaagcauacuuggggcagccagugaagcacgccgugaucaccguccccacuuauuucagcaacucccagcgccaagccaccaaagacgcaggggccauugcgggccugaaggugcucccaaucaucaaugaggccaccgcagccgcaauugccuacgggcuggauaggcggggcgccgguaaacgcaacguacugaucuuugaccucgggggcggcacguucgaugugaguguccugagcauugacgcggggguguuugaagugaaggcaacugccggugauacccauuugggcggggaggacuucgacaauaggcuggucaaccacuuuauggaggaguuccggcgcaaacauggcaaggaucucuccgguaauaagagggcccugcggcgccugaggacugcaugcgagcgggccaaacgcaccccgagcaguuccacccaggcgacuuuggaaaucgacagccucuucgagggcguggauuuuuauaaguccauuacgagggcccgguucgaagaacuguguagugaccuguuuaggagcacccucgagcccguagaaaaagcacugcgcgaugccaaguuggacaaagcacagauccacgauuucgugcuggguggcgggcuccacucccauccacagggugccgaggucgccgcaggccugcugcaacggcagggggccgaacaggagcaccaacccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6926 - RNA, 2217 nt, Artificial Sequence
  mRNA product Design5 comprising derived and/or modified sequence from Homo sapiens__NP_006588.1 __HsHSPA8 (opt7)
gggagagucccgcagucggcguccagcggcucugcuuguucgugugugugucguugcaggccuuauucaagcuuaccaugagcaagggccccgccguggggaucgaccuggguaccacuuacuccugcgucggcguguuccagcacgggaaaguagagauuaucgcaaacgaucaaggcaauaggaccacgccaaguuauguggccuuuacugacaccgaacggcucauuggugaugcggccaagaaccaggucgcaaugaauccgaccaacacuguguucgacgccaaacgccugaucgggaggcgguuugaugacgcagugguccagagcgauaugaagcauuggcccuucauggugguaaaugacgccggccgcccaaaagugcaggucgaguacaagggcgaaaccaaguccuuuuaucccgaggaagugaguagcaugguguugacgaaaaugaaggagauugcggaggccuaccuggggaaaacugucaccaacgcagugguaacugugccagccuauuucaaugauucccaaaggcaggccaccaaggacgcagguaccaucgccggccucaacguccugcggaucauuaaugaacccacggcggccgcaaucgccuacggguuggauaaaaaggugggcgcagagcgcaacgugcugauuuuugaccucggugggggcacuuucgaugucagcauccugaccauugaagacggcaucuuugaggugaaauccacugccggggacacccaccuggguggcgaggauuucgacaauaggaugguaaaccauuuuauugccgaauuuaagcggaagcacaaaaaggauaucagugagaauaaacgcgcggugaggcggcuccgcaccgcaugugaaagggccaagcggacucugagcuccagcacgcaggccaguaucgagauugacuccuuguaugaagggaucgauuucuacaccagcauuacucgcgcaagguuugaggagcugaacgccgaccucuuccggggcacccuggauccagucgaaaaagcgcugcgcgacgccaaguuggauaagucccagauccaugacauugugcucgucgguggcaguaccaggaucccgaaaauccaaaagcugcugcaggauuucuucaaugggaaagagcucaacaagagcauuaaccccgacgaagcaguggccuacggcgcagccgugcaggccgcaauccuguccggggacaaaagcgagaauguacaggauuugcugcuccuggacgugacuccacugaguuuggguauugaaacggccggcggggucaugaccgugcucaucaagcggaacacuaccauucccaccaagcaaacucagacguuuaccacuuauuccgauaaucagccaggcguccugauccaaguguacgagggugagagggcgaugaccaaagacaacaaucugcucggcaaguucgaacugacugggauucccccggcaccccgcggcgugccacagaucgagguaaccuuugauaucgacgccaacgggauuuugaaugugagcgccgucgauaaaaguacgggcaaggaaaacaaaaucaccauuacuaaugacaagggucggcuguccaaggaggauaucgaaaggauggugcaggaggccgagaaauauaaggcagaagacgagaaacagcgcgauaaggucagcagcaaaaacucccucgaaaguuacgcguucaauaugaaggccaccguggaggacgagaaacugcaagggaagauuaacgaugaagacaagcagaaaauccuggacaagugcaaugagaucauuaacugguuggauaaaaaucagacugcagaaaaggaggaauuugagcaccagcaaaaagagcucgaaaagguguguaaccccaucauuaccaagcuguaucagagcgccggcgguaugccaggcgggaugcccggcggguucccaggcgguggggccccgcccuccggcggcgcaagcagugggccaacgaucgaggaaguagacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6927 - RNA, 2316 nt, Artificial Sequence
  mRNA product Design5 comprising derived and/or modified sequence from Homo sapiens__NP_004125.3 __HsHSPA9 (opt7)
gggagagucccgcagucggcguccagcggcucugcuuguucgugugugugucguugcaggccuuauucaagcuuaccaugaucagcgccuccagggcagccgcggcccggcuggugggcgcagccgcaagucgcgggcccaccgccgcgaggcaccaggacagcuggaacggucucucccaugaggccuuccggcuggucagucgcagggauuacgcaagcgaagccauuaagggcgccgugguagggaucgacuugggcacuaccaauuccugcguggcagucauggaggguaaacaagccaaggugcuggaaaacgcggagggggcccggacgacuccaagcguggucgcauuuaccgccgauggcgaacgccucgugggcaugccggcaaaaaggcaggccguaaccaaucccaacaauacuuucuaugccaccaagcggcugauugggcgcagguacgacgauccagaggugcagaaagacaucaagaacguccccuuuaagauugugcgggcguccaauggugaugcauggguggaggcccacggcaaauuguauaguccaagccagaucggggccuucguccugaugaagaugaaagaaacggcagagaacuaccucggccauacugccaagaaugcggugaucaccguacccgccuauuuuaacgacucccaacgccaggcaacuaaagaugccggucagauuagcgggcugaaugugcugagggucaucaacgaaccaaccgcagccgcccucgcauacggccuggacaagagugaggauaaagugauugccguguaugacuugggcggggguaccuucgauaucuccauucuggagauccagaagggcgucuuugaaguaaagagcacgaauggggacacuuuccucggcggugaggacuuugaucaagcgcugcugcggcacauugugaaagaguucaagcgcgaaaccggcguggacuugacuaaagauaacauggcccuccagaggguccgggaagcagccgagaaggccaaaugugagcuguccaguagcgugcagaccgacaucaaucugccguaccucaccauggauuccagcgggcccaagcaucugaacaugaaguugacucgcgcacaguuugaaggcaucgucacggaccugauuaggcggaccaucgcgccaugccaaaaagccaugcaggaugcagaggugaguaaguccgacauuggggaagugauccucguagguggcaugacuaggaugcccaaagugcagcaaaccguccaggaucuguucgggcgcgccccaagcaaggccgugaaccccgacgaggcagucgccauuggcgcggccauccaggguggcgugcuggcaggggaugugaccgacguauugcuccuggacgugacuccgcugagucucggcaucgaaacgcugggcggggucuucaccaaauugauuaaucggaacacuaccauccccaccaagaagucccagguguuuagcacugccgccgauggucaaacgcaggucgagauuaaagugugucagggggagagggaaauggcaggcgacaauaagcugcucggucaguucacccugaucggcauuccacccgccccacgcggggugccccaaaucgagguaacuuuugauaucgacgcgaacggcauuguccacgugagcgccaaagauaaggggaccggccgggaacagcagaucgugauucaguccaguggugggcugagcaaagacgauaucgagaauauggucaagaacgcagaaaaguacgccgaggaggacaggcgcaaaaaggaacggguggaggcagugaauauggccgaaggcauuauccacgauacugagaccaaaauggaggaguucaaggaccaauugccagcggaugaaugcaacaaacucaaggaagagauuuccaaaaugagggaacugcuggcccggaaggacagcgagacgggcgagaauauccgccaggcagccaguucccuccagcaggccagccugaaguuguuugaaauggcauauaaaaagauggccuccgagagggaagggagugguagcuccggcaccggggagcaaaaagaagaucagaaggaggagaaacagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6928 - RNA, 2304 nt, Artificial Sequence
  mRNA product Design5 comprising derived and/or modified sequence from Homo sapiens__NP_079291.2__HsHSPA12A (opt7)
gggagagucccgcagucggcguccagcggcucugcuuguucgugugugugucguugcaggccuuauucaagcuuaccauggccgacaaggaggcaggcgggagcgauggucccagggaaaccgccccaacuuccgcguacaguagcccggcccggucccugggcgacaccgggaucacgccccucaguccaagccacauugugaacgauacugacuccaaugucagcgagcagcaauccuuccuggugguaguggcagucgauuuuggcaccaccaguagcgguuaugccuacuccuucacuaaagaacccgagugcauccaugugaugaggcgcugggaagggggcgacccaggcgugagcaaccagaagacccccacgacuauuuugcugaccccagagcggaaauuucacaguuucggguaugcagcccgcgauuuuuaccaugaccucgauccgaaugaggcgaagcaguggcuguauuuggaaaaauucaagaugaagcugcacacuaccggugaccucaccauggauacggaccugacugccgcaaacggcaaaaaggucaaagcccuggagaucuuugccuacgcacuccaguauuucaaggaacaagcccugaaagaguuguccgaucaggcggggagcgaguuugaaaauuccgacgugagguggguaauuaccgugcccgccaucuggaagcagccagcaaaacaguucaugcggcaagccgcauaccaggccggccuggccagucccgagaacagcgaacagcucaucauugcgcuggagccagaagcagccuccaucuacugucgcaagcugagguugcaucagaugauugagcucagcaguaaggccgcagucaaugguuauuccgggagcgacacugugggcgccggcuuuacccaagcgaaagagcacauccggcgcaacaggcagagucggaccuuccugguggaaaaugucauuggggagaucugguccgaacuggaggaaggugauaaguacgugguaguggacagcggcgggggcacugucgaucucacggugcaccagauucgccugcccgagggucauuugaaagagcuguauaaggccaccggcgggccguacggcagccucgggguggacuaugaguucgaaaaacugcuguacaagaucuuuggugaagauuucaucgagcaauuuaagauuaaaaggcccgcagccugggucgacuugaugaucgcauucgaaucccggaagcgcgccgccgcaccagauaggacuaacccccucaauauuacccugccauuuaguuucaucgacuauuacaaaaaguuucggggccacagcguggagcaugcccugcgcaaauccaacguagauuucgugaaguggagcagucaggggaugcucaggaugucccccgacgcgaugaaugcccuguuuaagccaaccauugauagcaucaucgagcacuugcgggaccuguuccagaaaccggaagucuccacugugaaguuucucuuccuggucggcgguuuugcagaggcaccccuguugcagcaagccgugcaggccgcguucggcgaccagugcaggauuaucauuccacaggauguggggcucacgauccugaaaggcgccguacuguucgggcucgaccccgcagugauuaagguccgccggaguccacugaccuacggcgugggugucuugaacagguauguggaagggaaacaucccccggagaagcugcucgugaaggauggcacucgcugguguaccgacguauuugauaaauucaucagcgccgaccaauccguggcccugggugagcuggucaagcggagcuacaccccagcaaaacccagucaguuggugaucgucauuaauaucuauuccagcgaacacgauaacguguccuuuauuacugaccccggcgugaagaaaugcgggacgcugaggcucgaucugaccggcaccagugggacugccguaccagcgcgccgggagauccagacucucaugcaguucggcgacaccgaaauuaaggccacggcaaucgauauugccaccagcaaauccgucaagguggguaucgacuuucugaacuacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6929 - RNA, 2337 nt, Artificial Sequence
  mRNA product Design5 comprising derived and/or modified sequence from Homo sapiens__NP_443202.3 __HsHSPA12B (opt7)
gggagagucccgcagucggcguccagcggcucugcuuguucgugugugugucguugcaggccuuauucaagcuuaccaugcuggccgugcccgagaugggccuccaggggcuguacaucgguagcuccccagaaaggaguccgguccccagcccacccggcuccccacggacccaagagaguugcgggauugcacccuugacuccaagccaguccccgaagcccgaagugcgcgccccacagcaggcgagcuucuccguaguggucgccaucgacuuuggcaccacgaguagcgguuaugcauucuccuuugccagcgaucccgaggcaauucacaugaugaggaaaugggaagggggcgacccaggcguggcccaucaaaagacucccaccugucugcuccugaccccggagggggcguuccacaguuuugguuacacugcccgggauuauuaccaugacuuggaucccgaggaagcacgcgacuggcuguauuucgagaaauuuaagaugaaaauccacuccgccaccgaucucacgcugaagacucagcuggaagccgugaacggcaagaccaugccagcacucgaggucuucgcccaugcgcugagguuuuuccgggagcacgccuugcaggaacugcgcgagcagagccccucccucccagaaaaagacacugugagguggguacugaccgugcccgcaauuuggaagcaaccagccaaacaguuuaugcgggaggcagccuaccuggccggguuggucagucgcgaaaaugcggagcagcuccugaucgcacuggagccggaagccgccagcguguauugcaggaagcuccggcugcaccaguugcuggaucucuccggccgcgcacccggugggggcaggcugggcgagcggcgcagcaucgacaguuccuucaggcaagcccgggaacagcugcgcaggagccggcauaguaggaccuucuugguggaguccggggucggugaacucugggcggagaugcaggccggcgaucgcuacgugguagcagacugugggggcgguacgguggaucugacuguccaccaacuggagcagccacauggcacccucaaagaacuguacaaggccagcgggggccccuauggggcaguggguguggacuuggccuuugagcagcugcucugccggauuuucggcgaagacuuuaucgccacuuucaaaaggcagcgcccagcagccugggucgaucugaccauugcguuugaggcccggaagaggaccgcagggccccaccgcgccggcgcccugaacaucagcuugccguucuccuuuauugacuucuaccggaagcaaaggggucacaauguggaaacugcacuccggcgcaguagcguaaacuuugugaaaugguccagccagggcaugcugaggaugaguugugaggcgaugaaugagcuguuccagccaacggucuccgggaucauucagcauaucgaagcccuccuggcacggcccgaggugcaaggcgucaaguugcuguuucucguagggggcuucgccgaaagcgccgugcugcagcacgcagugcaggccgcgcugggugcccgcggguugaggguggucgugccccaugaugucggccugaccauccucaaaggugcagugcuguuuggccaggccccaggggugguacgggugcgcaggaguccccucacuuauggcgucggggugcugaaccgguucgucccaggcaggcacccgcccgagaaguugcuggugcgcgacggucggagguggugcaccgauguguucgagcgcuuuguagccgcagaacaauccgucgcccucggggaggaagugcggaggagcuacuguccagcgcgccccggccagcggagggugcugauuaaucuguauugcugugccgcagaggacgcccgcuucaucaccgauccaggcguccggaaaugcggggcauugucccuggaacucgagcccgccgacugcggucaggauacugcgggcgccccgccagggaggcgcgagauucgggcagccaugcaguuuggcgacacggaaaucaaggugaccgccguggauguaagcacuaacaggaguguccgcgcauccauugacuuccugagcaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6930 - RNA, 1692 nt, Artificial Sequence
  mRNA product Design5 comprising derived and/or modified sequence from Homo sapiens__NP_008879.3__HsHSPA13 (opt7)
gggagagucccgcagucggcguccagcggcucugcuuguucgugugugugucguugcaggccuuauucaagcuuaccauggccagggagaugaccauccugggcagcgcagugcucacucuguugcuggccggguaccucgcgcagcaauaucugcccuugccaaccccgaaggucauugguaucgaccugggcacgacuuacugcuccguggggguauucuuucccggcaccgguaaagugaaggucauuccagaugaaaacgggcacaucaguauucccagcaugguguccuucaccgacaaugauguguaugucggcuacgagaguguggaacucgccgacagcaacccacagaauacuaucuaugaugcaaaacgguuuaucggcaagauuuucaccgccgaggaacuggaggcagagaucgggcgcuaccccuuuaaaguacugaacaagaaugguaugguggaguucuccgucacgagcaacgaaacuauuaccguguccccagaauaugugggcaguaggcuccuguugaagcugaaagagauggccgaggcguaccucgggaugccggucgccaaugcagugaucagcguacccgccgaauuugaccugaagcagcggaacuccacuauugaggccgcaaaucuggccggcuugaaaauccuccgcgugauuaacgaaccaaccgcggccgcaauggccuacggucugcauaaggcagaugucuuccacgugcuggugaucgaccucgggggcggcacccuggaugucagcuugcugaauaaacaaggggguauguuucucacgagggccaugaguggcaacaauaagcucgggggccaggacuucaaccagcggcuguugcaguaucucuacaaacagaucuaucaaacuuacgguuuugugcccucccgcaaggaggaaauucauaggcugcggcaggccguagagauggugaagcugaaucucacccugcaccagagcgcgcaguuguccguccugcucacuguggaggaacaagaucgcaaagagccacauaguagcgacaccgaacugcccaaggauaaacuguccagcgcagacgaccacagggucaacaguggcuucgggcggggcuuguccgauaagaaaagcggggagagucaggugcuguucgaaaccgagaucucccgcaagcuguuugacacucugaacgaggaucucuuccagaagauucuggugccgauccaacagguauugaaagaaggucaccuggagaagacggaaauugacgaggugguccucgugggcgggagcaccaggaucccccggauccgccaggucauucaggaauuuuucggcaaagauccaaauacuagcguggaccccgaucuggccgugguaaccgguguggccauccaagcaggcauugacgggggcuccuggccacugcaggucagugccuuggagauccccaacaagcaucugcagaaaaccaauuuuaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6931 - RNA, 1806 nt, Artificial Sequence
  mRNA product Design5 comprising derived and/or modified sequence from Homo sapiens__NP_057383.2__HsHSPA14 (opt7)
gggagagucccgcagucggcguccagcggcucugcuuguucgugugugugucguugcaggccuuauucaagcuuaccauggccgcaaucggcgugcaccuggggugcaccagcgccugugucgcgguguacaaggacgguagggccggcguaguggcaaacgaugccggggaccgggucacucccgcagugguggccuauuccgagaaugaagagauugucggccucgcggccaaacagagucgcaucaggaacauuagcaauaccgugaugaagguaaaacaaauccugggucgguccaguagcgauccacaggcacagaaguacauugccgaauccaaaugcuuggugaucgagaagaacgggaagcugcgcuaugaaaucgacacgggcgaggagacuaaauucgucaauccggaagauguggccaggcucauuuuuagcaagaugaaagagaccgcacauuccgugcugggcagugacgccaacgaugucgugaucaccguacccuucgacuuuggggaaaagcagaaaaaugcguugggugaggccgcacgggccgcaggcuucaacgugcugcgccucauucacgagccaagcgccgcccugcuggcguacgggaucggccaagauucccccacugguaagagcaauauucucgucuuuaaacugggcgggaccaguuugucccugagcgugauggaagugaacuccggcaucuauaggguccucaguacgaauacugacgauaacauugggggugcacauuucaccgagacucuggcccaguaccuggccagcgaauuucagcgguccuucaagcacgacgugcgcggcaaugcaagggccaugaugaaguugaccaacagcgcggagguagccaaacauagucucuccacccuggggagcgcaaauuguuuucuggauagucucuaugaaggccaggacuucgacugcaacgugucccgggcccgcuuugagcuguuguguagcccacuguucaacaagugcaucgaggcaaucaggggucuccuggaucaaaauggcuucacggccgacgauauuaacaaagucgugcugugugggggcagcucccggauccccaaguugcagcagcucauuaaagaccuguuuccagccgucgaacugcucaauaguaucccgcccgaugaggugauuccaaucggggcagccaucgaagcggguauucugaucggcaaggagaacuugcugguggaagacagccucaugauugagugcuccgcccgcgauauccugguaaaggggguggacgagagcggcgcaaguagguucacuguccuguuucccuccgguaccccauugcccgcccggcgccagcacacucuccaagccccgggcagcauuuccagugugugucuggaacuguacgagagcgaugggaaaaauuccgcaaaggaagagaccaaauucgcgcaggucgugcuccaggaccuggauaagaaagaaaacggcuugagggacauccuggccgugcucaccaugaagcgggacgggagccugcacguaacuugcacggaucaagagaccggcaagugcgaggcaaucaguauugaaaucgccuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6932 - RNA, 2853 nt, Artificial Sequence
  mRNA product Design5 comprising derived and/or modified sequence from Homo sapiens__NP_006635.2 __HsHSPH1 (opt7)
gggagagucccgcagucggcguccagcggcucugcuuguucgugugugugucguugcaggccuuauucaagcuuaccaugagcguggucggccuggacguggggucccagaguugcuacaucgccguagcaagggccgguggcauugaaaccaucgcgaacgaguucagcgaucgguguacucccuccgugauuaguuuugggagcaagaaucgcaccaucggcgucgccgccaaaaaccaacagauuacgcacgcaaauaacacuguguccaauuucaagagguuucauggucgggcauucaacgacccauuuauccagaaagagaaggaaaaucucagcuaugaucuggugccguugaaaaacgggggcgucggcaucaaggugauguacaugggggaggaacaccuguucuccguagagcagauuaccgccaugcuccugaccaaguugaaagagacugcggaaaauagucugaagaaacccgugaccgacugcgucaucagcgugccauccuuuuucacggaugccgagcgcaggagcgugcucgacgcagcccaaauugucggucugaacugucugcggcucaugaaugauaugacugccguggcacugaacuauggcaucuacaagcaggacuugcccagucuggaugaaaaaccacgcauuguaguguuugucgacauggggcauuccgccuuccaggugagcgcgugcgccuuuaauaagggcaaacucaaggugcuggguaccgcauucgaucccuuccugggcgggaagaacuuugacgagaaauuggucgagcacuucugugccgaauuuaagacuaaauauaagcucgaugcaaaauccaagaucagggcccugcugcggcucuaccaggagugcgaaaagcugaaaaaguugaugaguagcaauuccaccgaccugccacucaacauugaguguuucaugaacgacaaagaugugagcggcaagaugaaucgcagucaauuugaagaacugugcgccgagcuguugcagaaaaucgaaguaccgcucuauucccugcuggagcagacccaucucaagguggaagacgucagcgcgguggagaucgucgggggugcaacgaggauucccgccgugaaggaacggaucgccaaauucuuuggcaaggauauuaguacuacccugaacgcagacgaggccguggcgcgcgggugugccuugcagugcgcaauccuguccccagccuucaaaguaagggaguuuagcgugacugaugcaguccccuucccaauuagccucaucuggaaucacgacuccgaagauaccgagggcgugcacgaagucuuuagucggaaccaugccgcccccuucagcaaggugcugaccuuucugcgcagggguccguucgaguuggaagcauucuacuccgacccccaaggcgugccauaccccgaggccaaaaucgggcgguuuguagugcagaaugucagcgcgcagaaggauggcgagaagagucgcgugaaagucaaggugagggugaacacucacgggauuuucacgaucuccaccgccagcaugguagaaaaagucccaacugaggaaaaugagauguccagugaggcagacauggaaugccucaaccaacggcccccagagaauccggauaccgacaagaacgugcagcaggacaauagcgaagccgguacccagccccaagugcagacugaugcccagcagacgucccaaagcccacccaguccagagcugaccuccgaagagaacaaaauucccgacgcagauaaggcgaaugagaaaaaggucgaccagccgccagaagccaagaaacccaagaucaaaguggugaacguagagcugcccauugaagcaaaucucgucuggcagcugggcaaggauuugcugaacauguauaucgagacugaagggaaaaugaucaugcaggacaagcucgagaaggagaggaacgaugccaaaaaugccguggaagaguacguguaugaauuucgcgacaagcuguguggcccauacgagaaauucauuugcgaacaagaucaucagaacuuucugcgguugcugaccgagaccgaggacuggcucuaugaagagggugaagaucaggcaaagcaggccuacgucgacaaacuggaggagcucaugaagaucggcacucccgugaagguaagguuccaagaagcggaggaacgcccaaaaauguuugaggaacuggggcagcgguugcagcacuaugccaagauugcagccgauuucaggaauaaagacgagaaguacaaccacaucgacgagagcgaaaugaaaaagguggagaaauccgucaaugaagugauggaguggaugaacaaugugaugaacgcccaagcaaagaagagucuggaucaggacccggucgugcgcgcccaggaaauuaaaacgaagaucaaagagcucaauaacaccugugagcccguagugacucagccaaagcccaaaauugaaagcccaaagcuggagcggacccccaauggcccgaacaucgauaagaaagaagaggaccuggaggauaagaauaacuuuggggcggaaccaccccaucaaaauggcgagugcuacccaaacgagaaaaacuccgucaauauggacuuggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6933 - RNA, 3276 nt, Artificial Sequence
  mRNA product Design5 comprising derived and/or modified sequence from Homo sapiens__NP_006380.1 __HsHYOU1 (opt7)
gggagagucccgcagucggcguccagcggcucugcuuguucgugugugugucguugcaggccuuauucaagcuuaccauggccgacaaggugaggcggcagcgccccaggcggcgcgucugcugggcacugguggccguacuccuggcggauuugcuggcccucagcgacacccuggcagugauguccgucgauuugggcagugagagcaugaaaguggccaucgugaagccaggggucccgauggaaauugugcugaacaaagaguccaggcggaagacucccguaaucgugacccucaaagaaaaugagcgcuucuuuggugacagugcagccagcauggcgauuaagaacccaaaggccacgcugagguacuuccaacaucugcucggcaaacaggcagauaauccccacgucgcccuguaucaggcccgguuuccagaacacgaguugacuuucgacccccagcgccaaaccgugcauuuucagaucuccagccagcugcaguucuccccagaggaagugcucgggaugguccugaacuacaguaggagccuggcagaggauuuugccgaacaaccgauuaaggacgcggugaucaccguacccguguucuuuaaucaggccgagcggcgcgcagucuugcaggccgcaaggauggccggccucaaagugcugcagcugaucaacgauaauacugccaccgcgcucuccuaugguguguuccggcgcaaggacauuaacacgacugcacaaaauaucauguuuuacgauauggggagcggcaguaccgucuguacuauugugaccuaucagaugguaaaaaccaaggaggccggcaugcagccacaacugcagaucaggggugugggguucgaccggacguugggcgggcuggaaauggagcuccgccugagggaacggcuggccggcuuguucaacgagcagaggaaaggucagcgcgcaaaggauguccgggaaaaucccagggccauggcgaagcuccugcgcgaggccaaccggcugaaaacugugcucuccgcaaaugccgaccacauggcacaaauugaggggcugauggacgaugucgacuuuaaggccaaagugaccaggguggaguucgaggaauugugcgccgaucuguuugagcgcguaccaggccccgugcagcaggcacuccagagcgccgaaaugucccuggacgagaucgagcaagucauucuggugggcggggcgacucgggucccgagggugcaggaaguguugcucaaggccguagguaaagaggaacugggcaagaacaucaaugcagaugaggccgccgcaaugggggcgguguaccaggccgcagcccugaguaaggccuucaaagucaagcccuuugugguccgggacgcagugguguauccaauccucguagaguucacccgcgaggucgaggaagaacccggcauucauagccugaaacacaacaagaggguguuguuuucccggauggguccauacccccagcgcaaagugaucaccuucaacagguacagccacgauuuuaauuuccauauuaacuauggcgaccugggguuucucggcccagaagaucugcgggucuucgggagucaaaaucugacuacggugaaguugaagggugugggcgacuccuuuaaaaaguacccggauuaugagagcaaagggaucaaggcccacuucaaccuggacgagaguggcguacucucccuggaccgcgucgaaagcguguucgagacccucguggaagauagcgcggaggaagaguccacucugaccaaauuggguaauaccauuaguagccuguuuggcgggggcacuacgcccgacgccaaggagaacgggaccgauacuguccaggaagaggaagaguccccagcagaaggcagcaaggacgagcccggugaacagguggaacucaaagaggaagccgaggccccaguagaagaugggagucagcccccgccacccgagcccaagggcgacgcaaccccagagggugaaaaagccaccgagaaggaaaauggcgauaaauccgaggcgcaaaagcccagcgagaaagccgaagcagggccagagggcguggccccggcacccgaaggggagaagaagcagaaaccagccaggaagcggaggauggucgaagagaucggcguggagcuggugguccuggacuugcccgaucugccagaagacaaacucgcgcaguccgugcaaaagcugcaggaucucacucugcgcgacuuggagaaacaggaacgggagaaggccgcaaacagucuggaagccuucaucuuugagacgcaggauaagcuguaccaacccgaguaucaggaaguaagcaccgaggaacagagggaggagauuuccgguaaacucagcgccgcaaguacuuggcuggaagacgagggggugggcgccaccacugucauguugaaggaaaaacuggcggagcuccgcaagcugugucagggccucuucuuucggguggaagagaggaaaaaguggccggagcgccuguccgccuuggacaaucugcugaaccauagcuccauguuccucaagggggcacggcugaucccagaaauggaucaaauuuuuaccgagguggaaaugacgaccuuggagaaagucaucaaugaaacuugggccuggaagaacgcaacccuggccgagcaggccaaacuccccgcaacugagaagccagugcugcugaguaaagacauugaagcgaagaugauggcccucgauagggagguacaguaccuguugaauaaagccaaguucaccaagccccgcccgcggcccaaagacaagaacgguacgagggcagaaccaccccugaaugccagcgcauccgaucagggcgagaaagugaucccacccgccgggcaaaccgaagacgcggagccaaucagcgagccggaaaaggucgagacuggcagugaacccggugauaccgagccacucgagcugggcgggcccggcgccgaaccagagcagaaagaacaguccacugggcaaaagcgccccuugaagaacgacgagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6934 - RNA, 2475 nt, Artificial Sequence
  mRNA product Design5 comprising derived and/or modified sequence from Homo sapiens__NP_005339.3 __HsHSP90AA1 (opt7)
gggagagucccgcagucggcguccagcggcucugcuuguucgugugugugucguugcaggccuuauucaagcuuaccaugcccgaggaaacccagacucaagaccagccaauggaggaagaggaaguggagaccuucgccuuucaggcagagaucgcccagcugaugagccucauuaucaacacguucuacuccaauaaggaaauuuuucugagggaguugaucaguaacagcuccgaugcgcuggacaaaauucgguaugaaagucucacugauccgagcaagcuggacuccggcaaagaguugcacaucaaucugauccccaacaagcaagaucgcacccucaccauugucgacacugggaucgguaugaccaaagccgaucugauuaauaaccugggcacgaucgcaaagagcgggacuaaggccuucauggaggcacuccaggccggcgcggacauuuccaugaucggucaguuuggggugggcuucuacagugccuaucugguagcagaaaaagugaccgucauuacuaagcauaaugaugacgagcaguacgccugggaaagcuccgccggcgggagcuuuaccgugaggaccgauacgggugagccaaugggccgggggacuaaagugaucuugcaccugaaggaagaccaaaccgaguaucucgaggaacgcaggaucaaagagauugucaagaaacauagucaguucaucggcuaccccauuacucuguuuguggaaaaggagcgggauaaggaaguauccgacgacgaggcagaggaaaaagaggauaaggaagaggaaaaagagaaggaggaaaaagagagcgaagacaagccagagaucgaggauguggguuccgacgaagaggaagagaagaaagauggggacaagaaaaagaaaaagaagauuaaagaaaaguauaucgaucaggaggagcugaacaaaaccaagcccaucuggacccgcaauccagacgauauuacuaacgaagaguacggcgaguucuacaaaaguuugacgaaugacugggaggaucaccucgccgucaagcauuuuagcguggaaggccagcuggaguucagggcgcuccuguucgugccgcggcgcgcccccuuugaccuguucgagaacaggaagaaaaagaauaacaucaaauuguauguccggcgcguguuuauuauggacaauugcgaagaacugaucccagaauaccucaacuucauuagggguguaguggauuccgaggaccugccccugaacaucagccgggaaauguugcaacagaguaagauccucaaagucauucgcaagaaucuggugaaaaagugucuggagcucuuuaccgagcuggcagaagauaaggagaacuauaaaaaguucuacgaacaguuuuccaaaaauaucaaguuggggauucacgaggacagccaaaacaggaaaaagcugagugagcuccugcgguauuacacuuccgccagcggcgaugaaauggugagccugaaggacuauugcacccgcaugaaagagaaucagaagcacaucuacuacauuaccggggaaacuaaagaucaggucgcaaacuccgccuucguggagagguugcggaagcauggccucgaaguaaucuauaugauugagccaaucgacgaguacugugugcagcaacugaaagaauuugaggguaagacgcuggucagugugaccaaggaaggccucgagcugcccgaagaugaggaggagaaaaagaaacaggaagaaaagaaaacuaaguucgagaauuugugcaaaaucaugaaggacauucuggagaagaaagucgaaaagguggugguaagcaacaggcucgugaccuccccguguugcaucgucaccagcacuuauggguggacggccaauauggagcgcauuaugaaagcgcaggcacugcgggauaacaguaccaugggcuacauggccgccaagaaacaccuggaaaucaaucccgaccauuccauuaucgagacuuugaggcagaaggcagaagccgauaagaacgacaaaagcgugaaggaccuggucauccuccuguaugagaccgcgcuccuguccaguggguuuagcuuggaggauccacaaacucacgccaaucgcauuuaccggaugaucaaacugggucucggcauugacgaagaugaccccaccgcagaugacacguccgccgcagugaccgaggaaaugccaccccuggagggggaugacgauacuagcaggauggaagagguggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6935 - RNA, 615 nt, Artificial Sequence
  mRNA product Design5 comprising derived and/or modified sequence from Homo sapiens__NG_005218__HsHSP90AA3P (opt7)
gggagagucccgcagucggcguccagcggcucugcuuguucgugugugugucguugcaggccuuauucaagcuuaccauggacagcuccaagcuggauaguggcaaagggcuccacaucaaccuggugcccaauaagcagaaccaaaccuugacuauugucgacaccaggaucgguaugacgaaaacugaucugauuaauaaccucggcaccgugaccaagagcgggacuaaagccuucauggaggcacugcaggccgacgcggauaucuccaugauuggccauuuugguguaggguucuacagugccuauuugguggcaaagaaggucaccgugaucagcaaacacaauaacgacgaacaguacacgugggaguccagcgccggcggcuccuuuacugugcggaccgaugaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6936 - RNA, 2451 nt, Artificial Sequence
  mRNA product Design5 comprising derived and/or modified sequence from Homo sapiens__NP_031381.2__HsHSP90AB1 (opt7)
gggagagucccgcagucggcguccagcggcucugcuuguucgugugugugucguugcaggccuuauucaagcuuaccaugcccgaggaagugcaccauggcgaggaagaggucgaaaccuucgccuuucaggcagagaucgcccaacugaugagccucauuaucaacacuuucuacuccaauaaggagauuuuucugagggaauugaucaguaacgcgagcgacgcccuggauaaaauucgguaugagucccucaccgacccaaguaagcuggauagcgggaaagaauugaagaucgacaucauuccgaauccccaggagcgcacgcugacucucguggauaccgguaucggcaugaccaaagcagaccugauuaacaaucuggggacuaucgccaaguccggcaccaaggcauucauggaggcccuccaggcgggugccgauauuagcaugaucgggcaguuuggcguaggcuucuacuccgcauaucugguggccgaaaaagucguggugauuacgaagcacaacgacgaugagcaauacgccugggaaaguagcgcaggggguuccuuuacugucagggccgaccauggcgagccaaucgggcggggcaccaaagugaucuugcaccugaaggaagaucagacugaguaucucgaggaacgcaggguaaaagagguggucaagaaacauagccaguucauugguuaccccaucacccuguaucuggaaaaggagcgggaaaaggagauuagugacgaugaggcggaagaggaaaaaggggagaaggaagaggaggacaaagacgaugaagagaagccaaaaaucgaagacgugggcuccgaugaggaggacgauagcggcaaggacaagaaaaagaaaaccaagaaaauuaaggaaaaguacaucgaucaggaggaauugaauaaaacgaagcccaucuggacucgcaacccagacgauauuacccaagaggaauacggggaguuuuauaaaucccucacuaaugacugggaggaucaccuggccgugaagcacuucagugucgaaggucagcuggaguuuagggcacuccuguucaucccgcggcgcgcccccuucgacuuguuugaaaacaaaaagaagaaaaauaacauuaagcuguacgugaggcggguauucaucauggacagcugcgaugagcucauuccagaauaucugaauuuuauccgcggcguggucgacuccgaggaucugcccuugaacaucagcagggagaugcuccagcagaguaaaauucugaaggugauccggaaaaauauugugaagaaaugucuggaacucuucuccgagcuggcagaagacaaggagaacuacaagaaauuuuaugaagccuucagcaagaacuugaaacuggggauccaugaggauaguaccaaucgcaggcggcucuccgagcugcugcgcuaccacaccagccaaagcggcgacgaaaugacuuccuugagugaguaugucagcaggaugaaggaaacgcagaaauccauuuacuacaucaccggugagagcaaggaacagguggccaacagugcguuuguagagcgggugaggaagcgcggcuucgaggucguguauaugacugaaccaauugaugaguacugcguccaacagcucaaagaauuugacgggaagucccuggugagcgugaccaaagagggccuggagcuccccgaagaugaggaagagaagaaaaagauggaagaguccaaggcaaaauucgagaaucuguguaaguugaugaaagaaauccuggacaagaaaguagagaaggugaccaucaguaaccggcucgucagcuccccgugcuguauugugacuagcacguauggguggaccgccaauauggaaaggaucaugaaagcccaggcacugcgcgauaacaguacuauggguuacaugauggccaagaagcaucuggagauuaaucccgaccacccaaucgucgagaccuugcggcagaaagcggaagccgauaagaacgacaaagcagugaaggaccuggugguacuccuguuugagaccgcccuccuguccagcggcuucuccuuggaagauccccaaacucacaguaauaggauuuaucgcaugaucaaacuggggcucggcaucgacgaggaugaaguggcagccgaggagccaaacgccgcaguccccgacgaaauuccaccgcuggagggugaugaagacgccagccggauggaggaaguggauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6937 - RNA, 2688 nt, Artificial Sequence
  mRNA product Design5 comprising derived and/or modified sequence from Homo sapiens__NP_003290.1__HsHSP90B1 (opt7)
gggagagucccgcagucggcguccagcggcucugcuuguucgugugugugucguugcaggccuuauucaagcuuaccaugagggcccugugggugcucggccugugcugugucuugcugaccuucgggagcgugcgggcagacgaugagguagacguggaugguacugucgaagaggaccucggcaagucccgcgaagggaguaggaccgaugacgagguggugcagcgggaagaggaggccauccaacuggauggcuugaacgcgagccagauucgcgaacugagggagaaauccgaaaaguuugccuuccaggcagaggucaaucggaugaugaaacucaucauuaacagucuguacaagaauaaagagaucuuucugcgcgaacucauuagcaacgccuccgacgcacuggauaagaucagguugaucagccugacggacgagaaugcccucuccgguaacgaagaacugacugugaagauuaaaugcgauaaggagaaaaaucuguugcacguaaccgacaccggggugggcaugacucgggaggagcucgucaagaaccugggcaccaucgcgaaaagugggacgagcgaguuccugaauaagaugacugaggcccaggaagauggucaauccaccagcgagcucauuggccaguuuggggugggcuucuauagugcauuucugguggccgacaaagucaucgugacuuccaagcauaacaaugacacccagcacauuugggaaagcgauuccaacgaguucaguguaaucgccgacccccgcgguaauaccuuggggaggggcacgacuauuacccuggugcucaaggaggaagcaagcgauuaccuggagcuggacacuaucaaaaacuuggucaagaaauauucccaguuuaucaauuucccaauuuacguguggagcaguaagaccgaaaccguggaggaaccgauggaggaggaagaggccgcgaaagaagagaaggaggaauccgaugacgaggccgcagucgaagaggaagaggaggaaaagaaacccaagacuaaaaagguggagaaaacgguaugggauugggaacucaugaacgacaucaagccaauuuggcaacggcccagcaaggagguggaagaggaugaguauaaagccuuuuacaagaguuucuccaaagaaagcgacgauccaauggcauauauccauuucaccgccgagggcgaagucacuuuuaagagcauucuguucgugcccaccuccgccccacgcgggcuguuugacgaguacgguaguaaaaagagcgacuacaucaagcucuaugucaggcggguguucaucaccgaugacuuucacgauaugaugccgaaauaccugaacuucgugaagggcguaguggacuccgaugacuugccccugaaugucagccgcgaaacucuccagcagcauaaacugcugaaggugauuaggaaaaaguugguccggaaaacgcucgauaugaucaagaagauugcggacgauaaauauaacgacaccuuuuggaaggaguucgggacuaauaucaaacugggcgugauugaggaucacaguaaccgcaccaggcuggcaaagcuccugcgguuucaguccagccaccauccaaccgacaucacuuccuuggaucaauacguggaaaggaugaaagagaagcaggacaagaucuauuucauggccgguaguagccgcaaagaagccgaguccagccccuuuguagagcggcugcucaagaaaggcuacgaagugauuuaucugacggagccagucgacgaauacuguauccaggcacugcccgaguucgaugggaagagguuucaaaauguggccaaagaaggcgucaaguucgacgagagugagaagaccaaagaaucccgcgaggcgguggaaaaggaguucgaaccguugcugaacuggaugaaagauaaggcccucaaagacaagauugagaaagcagugguaagccagcggcugacugagucccccugcgcccucgucgcaagucaguacggguggagcgguaauauggaaaggaucaugaaggcccaggccuaucaaaccggcaaggauauuuccacuaacuacuaugcaagccagaaaaagaccuuugagaucaauccacgccacccccugauucgggacauguugaggcggaucaaagaagaugaggacgauaagacggugcuggaccucgccgugguccuguucgagaccgcgacucugcgcaguggguacuugcugccagauaccaaagccuauggcgacaggaucgaacggaugcuccgccugucccucaacauugaccccgaugcaaagguggaggaagaaccagaagaggagccggaagagacugccgaagacaccacggaggauaccgaacaggacgaggaugaggaaauggacguggguacugaugaggaagaggaaaccgccaaggagagcacugcagagaaagacgaacugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6938 - RNA, 2391 nt, Artificial Sequence
  mRNA product Design5 comprising derived and/or modified sequence from Homo sapiens__NP_057376.2__HsTRAP1 (opt7)
gggagagucccgcagucggcguccagcggcucugcuuguucgugugugugucguugcaggccuuauucaagcuuaccauggccagggagcugcgggcacuccuguuguggggccgcaggcugcggccccuccugcgcgccccagcguuggccgcagugcccggggguaagccgauccugugcccaaggcggaccacugcccagcucggcccccgcaggaacccagcauggagccugcaagccgggcggcuguucuccacccagacggcggaagacaaagaggaaccccuccacaguauuaucagcuccacugagaguguccagggcagcaccuccaagcaugaauuucaggccgagaccaaaaagcuguuggauauuguggcacgcagccuguacuccgagaaagaaguauucaucagggagcucauuaguaaugccagcgacgcccuggaaaagcugcggcacaaguugguguccgauggucaagcacucccagagauggagauccaucugcagacuaacgccgaaaaagggaccaucacgauucaggacacuggcaucggcaugacccaggaggaacuggucagcaaucucgggacuauugcgcgcagugguuccaaggccuuucuggaugcauugcaaaaccaggccgaggcaagcuccaaaaucauuggccaguucggggugggcuuuuauagugccuucaugguggccgacagggucgaaguguacagccgguccgcggcaccggguagccugggguaucaguggcucagugauggcuccggcguauuugagaucgccgaggccagcggggugcgcaccgguaccaagauuaucauccaccugaaaagugacuguaaggaguucuccagcgaggcaaggguccgggauguggugacgaaauacagcaauuuugucuccuucccccuguauuugaacggccgcaggaugaauacucuccaagccauuuggaugauggacccaaaggaugugcgggaauggcagcaugaggaauuuuacagguauguagcgcaggcccacgacaagccccgcuacacccugcacuacaaaacugaugcaccacugaacauccggaguauuuucuaugugcccgacaugaagccgagcauguucgacgucuccagggagcucgggagcaguguggcccuguacucccgcaaaguguugauccaaaccaaggcaaccgauauucugcccaaauggcuccgguuuaucaggggcgucguggacagcgaggauaucccacugaaucugucccgcgaauugcuccaggagagugcccugauucggaagcugagggacguacuccagcagcggcugaucaaguucuuuauugaucaaagcaaaaaggacgccgaaaaauaugcaaaguucuuugaggauuacgguuuguucaugcgcgaaggcaucgugacugccacggagcaggaggucaaagaagacauugcgaagcugcucagguaugaguccagcgcccugcccagugggcagcugaccuccuugagcgaauacgcaucccggaugcgcgccggcacuaggaacaucuauuaccugugcgccccaaaucggcaucucgcagagcacagucccuacuaugaggcgaugaagaaaaaggauaccgaagugcuguuuuguuucgagcaguuugacgaacucacccuguugcaucugcgcgaguucgauaaaaagaaacucaucagcgucgaaacugacauugugguggaccacuacaaggaggagaaguuugaagauagguccccagccgcagagugccugagcgaaaaagagacggaagaacugauggccuggaugcggaacguauuggggaguagggugaccaaugucaaggugacucugcgccucgacacccacccggccauggucaccgugcuggagaugggugcagcccggcauuuccucaggaugcaacagcuggcgaaaacucaggaggaacgcgcccaguugcugcaacccacgcuggaaaucaacccacggcacgcacucauuaagaaacugaaucaguugagggccuccgagcccggccuggcccagcuccugguggaucagaucuaugaaaacgcaaugauugccgcggggcucguagacgauccacgcgccauggugggccggcugaacgaguugcuggucaaggcacuggagaggcauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6939 - RNA, 738 nt, Artificial Sequence
  mRNA product Design5 comprising derived and/or modified sequence from Homo sapiens__NP_000609.1__HsIGF1 (opt7)
gggagagucccgcagucggcguccagcggcucugcuuguucgugugugugucguugcaggccuuauucaagcuuaccaugggcaagaucagcucccugcccacccaacucuucaaaugcuguuuuugcgacuuccugaaggugaaaaugcacacuaugaguagcucccauuuguuuuaccuggcccucugucuguugaccuucacgaguagcgcaacugccgggccagagacccugugcggugcggaacucgucgaugcccugcaguuuguguguggcgacaggggguucuauuuuaacaagccgaccggcuacgguuccagcucccggcgcgcaccccagacugggauuguagaugagugcuguuucaggaguugcgaccugcggcgccucgaaauguauugugccccacugaaacccgcaaagagcgccagguccgugcgggcgcagcgccacaccgauaugccaaagacgcagaaagagguccauuugaagaaugccagcaggggcagugcaggcaacaaaaauuaccggaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6940 - RNA, 819 nt, Artificial Sequence
  mRNA product Design5 comprising derived and/or modified sequence from Homo sapiens__NP_000603.1__HsIGF2 (opt7)
gggagagucccgcagucggcguccagcggcucugcuuguucgugugugugucguugcaggccuuauucaagcuuaccaugggcauccccauggguaagagcaugcuggugcuccugaccuucuuggccuuugcauccugcuguauugccgcguacaggccaagugagacucugugcgggggcgaacucgucgacacccugcaguucguguguggggaucggggcuuuuauuucagccgcccggccuccaggguaagucggcgcagcagggguaucguggaggaaugcuguuuucgguccugcgacuuggcacugcucgagacguacugugccacucccgcaaaaagcgaacgcgaugucuccaccccacccaccgugcugccagacaacuuccccagguauccaguggggaaguuuuuccaauacgauacuuggaaacagaguacccagcggcugcgcaggggccucccggcccuguugcgggcgcgcaggggccacguccuggccaaggagcucgaggcauuucgggaagccaaacgccauaggccccugauugcccugccaacgcaggaccccgcacacgggggugccccacccgagauggcgagcaaucggaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6941 - RNA, 915 nt, Artificial Sequence
  mRNA product Design5 comprising derived and/or modified sequence from Homo sapiens__NP_000591.1__HsIL6 (opt7)
gggagagucccgcagucggcguccagcggcucugcuuguucgugugugugucguugcaggccuuauucaagcuuaccaugaacagcuucuccaccagugccuuuggccccguggcauucagccuggggcuccuguugguccugccagccgcguuuccggcccccgugccacccggugaggacuccaaggauguagcagccccacacaggcagccccucaccaguagcgaacggaucgacaaacaaauucgcuacauccuggauggcauuuccgcauugaggaaggagacuugcaauaaaagcaacaugugugaauccaguaaggaggcccuggcggaaaauaaccucaaucugccaaaaauggccgagaaggacgggugcuuccagagcggcuuuaacgaggaaacgugucuggugaagaucauuacuggucuccuggaguucgaagucuauuuggaguaccugcagaaucgguuugaguccagcgaagaacaggcacgcgccgugcaaaugaguaccaaagugcucauccaguuccugcagaagaaagccaagaaccuggaugcaaucaccacuccggaccccaccacgaaugccuccuugcucacuaaacugcaggcgcaaaaccaguggcugcaggauaugaccacucaucucauucugaggagcuuuaaggaguucuugcaguccagucugcgggcccuccgccaaaugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6942 - RNA, 1557 nt, Artificial Sequence
  mRNA product Design5 comprising derived and/or modified sequence from Homo sapiens__NP_002183.1__HsINHBA (opt7)
gggagagucccgcagucggcguccagcggcucugcuuguucgugugugugucguugcaggccuuauucaagcuuaccaugccccugcucuggcugaggggcuucuugcuggccagcugcuggaucauugugcgguccaguccaaccccggggagcgagggucacuccgcagcccccgacuguccaaguugcgcgcucgccgcacugcccaaggaugucccaaacagccagcccgaaaugguggaggccgugaaaaagcauaucuugaauaugcugcaccucaaaaagcgcccagacguaacucaaccgguccccaaagcagcccugcugaacgcgauuaggaagcuccaugugggcaaggugggggaaaauggcuacgucgagaucgaagaugacauuggucggcgcgccgagaugaacgagcugauggaacagaccuccgagaucaucacguuugcagaaagcgggacugccaggaaaaccuugcacuucgagauuuccaaggagggcagugaucugagcgugguagaacgggccgagguguggcucuuucugaaagucccaaaggcaaaucgcaccaggacuaaagugaccauccggcuguuccagcagcaaaagcauccccagggcuccuuggacacgggggaagaggccgaagaggugggucucaaaggcgagcgcagcgaacugcugcucagugagaaggucguggaugcgaggaaguccacuuggcacguauuuccagugagcuccaguauucagcggcuguuggaccaggggaaaagcucccuggauguccgcaucgccugugaacaaugccaggagagcggcgcaagucucgugcugcuggguaagaaaaagaaaaaggaagaggagggggaaggcaagaaaaagggcgggggugagggcggggccggcgcagacgaagagaaagaacagucccacaggcccuucuugaugcuccaggcccggcaaagcgaggaucauccgcaccgcaggcggcgcaggggucuggagugugacggcaaggugaacauuugcuguaaaaagcaguuuuucgucaguuuuaaggauaucggguggaaugacuggauuaucgcccccuccggcuaucaugcgaacuacugcgaaggggaguguccaagccacaucgcagguaccagcggcuccagucugagcuuccacuccacugugauuaaucauuaucggaugagggggcacagccccuuugccaaccucaaaaguugcugcguaccaaccaagcugcgccccauguccauguuguacuaugacgauggccagaauaucauuaaaaaggacauccaaaacaugauuguggaagagugugguugcagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6943 - RNA, 1500 nt, Artificial Sequence
  mRNA product Design5 comprising derived and/or modified sequence from Homo sapiens__NP_002184.2__HsINHBB (opt7)
gggagagucccgcagucggcguccagcggcucugcuuguucgugugugugucguugcaggccuuauucaagcuuaccauggacggccugcccgggagggcccucggugcagccugccuguugcugcucgcggccggcuggcuggggccagaggcauggggcagcccgacucccccacccaccccagccgcacccccaccgcccccacccccagguucccccgggggcagucaggauaccuguacgagcugcggcggguuccggcgcccggaagaguuggguaggguggacggcgauuuucuggaagccgucaagcggcacauccucucccgccugcaaaugagggggcggcccaacauuacucaugcggugccaaaagccgcaaugguaaccgcccugcgcaagcuccacgccggcaaagugagggaggacggucgggucgaaaucccccaucuggaugggcacgcaaguccaggcgccgacggccaggagcgcgugagcgagauuaucuccuucgcggaaaccgauggguuggccagcuccagggugcggcuguacuuuuucauuaguaaugaggguaaccagaaucucuuugucgugcaggcaagccuguggcuguauuugaagcuccugcccuacguacuggaaaaaggcucccgcaggaaggugcgggucaagguguauuuccaagagcaggggcauggcgaccgcuggaacaugguggagaaaagggucgaucucaagcggagcgguuggcacacuuuuccacugaccgaagccauccaggcauuguucgagcgcggcgaaaggcggcugaaucucgacgugcagugugauaguugccaagagcuggccguagugccggucuuuguggaccccggggaagagucccacaggccauucguggucgugcaggcccgccugggcgauagccggcauaggauccgcaaacggggguuggagugugacgguaggacgaaccucugcugucgccagcaguuuuucauugacuuccggcugaucggcuggaaugauuggauuaucgcgcccacuggguacuauggcaacuacugcgaagguuccuguccagcauaucuggccggcguacccgggagugccagcuccuuucacaccgcaguggucaaucaauacaggaugcggggccucaacccggggacugugaauagcugcugcauuccaaccaagcugaguaccauguccauguuguacuucgacgaugaguauaacaucgucaaacgcgacgugcccaauaugauuguggaagaguguggcugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6944 - RNA, 3735 nt, Artificial Sequence
  mRNA product Design5 comprising derived and/or modified sequence from Homo sapiens__NP_000623.2__HsITGAM (opt7)
gggagagucccgcagucggcguccagcggcucugcuuguucgugugugugucguugcaggccuuauucaagcuuaccauggcccugagggugcuccuguugaccgcacugacucucugccacggcuucaaccuggacaccgagaaugccaugacguuucaggaaaacgcgcggggguucggucaaagcgucgugcaguugcagggcucccgcguaguggucggggcgccccaggagaucguggcagccaaucaaaggggcagucuguaccagugugauuauagcacugguuccugcgaaccaauucggcuccaggugccggucgaggcagugaacaugagucuggggcugagccucgccgcgaccaccuccccaccccagcuguuggccuguggccccacuguacaucaaaccugcagcgaaaauacguacgugaagggccuguguuuucucuucggguccaaccugcgccagcagccacagaaauuucccgaggcacugagggguugcccacaagaggacagugauaucgccuucuugauugacggcagcggguccaucauuccgcacgauuuucggcgcaugaaggaguucgucagcacugugauggaacagcucaaaaagaguaaaacccuguuuucccugaugcaguauagcgaagaguucaggauccauuuuacuuucaaggaguuccaaaauaaccccaauccacggucccucgugaagcccaucacccagcuguugggccgcacccacacggccacugguauuaggaaagucgugcgggaacuguuuaacaucaccaauggggcacgcaagaacgccuucaaaauucucguagugaucacugacggcgagaaguuuggcgauccacugggguacgaagacgucauucccgaggcggauagggaaggugugauccgguaugugauuggcgucggggacgccuuccgcagugagaaaagcaggcaggagcugaauaccaucgcauccaagccgccccgggaucauguguuucagguaaacaauuucgaagccuugaaaaccauccaaaaccagcuccgcgagaagauuuuugcaaucgaaggcacucagacggguagcaguuccagcuucgagcacgaaaugagucaggagggcuuuuccgccgccauuaccagcaacgggccacugcugagcacugugggcuccuacgacugggccgggggugucuuccucuauaccaguaaggagaaaagcaccuuuaucaauaugacuaggguggauuccgacaugaacgacgcauaccugggcuacgccgccgcaauuaucuugcggaauaggguccaaagccuggugcucggggcgccccgcuaucagcacaucggccugguggccauguuccggcagaacacggguaugugggaaaguaaugccaacguaaagggcacccagauuggggcauacuuuggcgccucccuguguagcguggaugucgacuccaaugggaguacugauuuggugcucaucggcgcaccacauuauuacgagcaaaccaggggugggcaggucagcgugugcccccugccacgcggccgggccagguggcagugugacgccgugcuguauggugaacagggccaaccgugggggcgcuucggcgcagcccucaccguacugggggaugugaacggcgacaaauugacugaugucgcgauuggugcccccggggaggaagacaaucggggcgcaguguaccuguuccacggcacguccgggagcgguaucaguccaucccauagccagaggauugccggcuccaagcucaguccccggcugcaguauuuugggcaaagccuguccggcggucaggauuugaccauggacgggcuggucgaucucacugugggcgcccagggccacgugcugcuccugcgcagccagccaguauugagggucaaagcaaucauggaguucaacccccgggagguggcgcgcaauguguuugaaugcaacgaccaagucgugaaggggaaggaggccggugaagugaggguaugccugcacguccagaaaaguacccgggaccgccucagggagggccagauccaguccguggugacuuacgaucuggcacuggacagcgggcggccgcauuccagggccgucuucaaugagaccaagaacagcacgcgccggcaaacccagguguugggccugacucagaccugugaaacucucaaacugcagcucccaaauugcauugaggaucccguaagucccaucgugcugagguugaacuuuagccuggucgguaccccacuguccgccuucgggaaccuccgccccgugcuggcagaagacgcccaacgguuguuuacggcgcuguucccauuugagaagaauuguggcaacgauaauauuugccaggacgaucucaguaucaccuucagcuuuaugucccuggacugucucguggucggcgggccgagggaguucaacgugacuguaaccgugcgcaaugauggugaagacagcuaccggacucaggucaccuucuuuuucccccuggauuuguccuauaggaaagugaguacgcugcaaaaccagcgcagccagcgguccuggaggcuggccugcgagagugcaagcuccaccgaagugagcggcgcccucaagaguacuuccuguagcauuaaucacccaaucuuucccgagaacuccgaagucaccuucaauauuacuuuugacguggauagcaaggccagucuggggaacaaauugcugcucaaggcaaauguaaccuccgagaacaauaugccacgcacgaacaaaaccgaguuccagcuggaacugcccgugaaguacgccgucuauaugguggugacuagccauggcgucaguaccaaauaccucaauuuuacugcguccgagaacaccagccgggugaugcaacaccaguaucagguauccaaccugggucagaggagcuugccgaucagucugguguuccucgucccagugcgccugaaucaaacugugaucugggaccggccccaggucaccuuuagcgaaaacuuguccaguacgugccauaccaaggagaggcugccaagccacuccgacuuccucgccgaacugcgcaaggcacccgugguaaauuguagcauugccgugugccagaggauccagugcgauauuccguuuuucgggauccaagaggaauuuaacgcaacucugaaaggcaaucucuccuucgacugguacauuaagaccagucacaaccaucuguugaucgucagcacugccgagauccuguucaaugauuccguguuuacccuccugcccggccagggggcguucgugcggagccagacggagaccaaagucgaaccauuugaggugcccaacccauugccccugauuguagguaguuccgugggcgggcuccugcugcucgcccugaucacugcagccuuguauaagcugggcuucuuuaaaaggcaguacaaggacaugaugagcgaagguggcccaccgggggccgagccccaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6945 - RNA, 1680 nt, Artificial Sequence
  mRNA product Design5 comprising derived and/or modified sequence from Homo sapiens__NP_002415.1__HsMMP8 (opt7)
gggagagucccgcagucggcguccagcggcucugcuuguucgugugugugucguugcaggccuuauucaagcuuaccauguucagccugaagacccuccccuuucuguugcugcuccacgugcagaucuccaaagccuucccagucaguagcaaggagaaaaacacuaagaccgugcaagacuaccuggaaaaauuuuaucaguugccguccaaucaguaccagaguacgaggaagaacggcacuaauguaauuguggagaagcugaaagaaaugcaacgguucuuugggcucaacgucaccgguaagcccaaugaggaaacccuggauaugaugaaaaagccacgcugcggcgugcccgacagcgggggcuucaugcugacuccagguaaccccaaaugggagaggaccaaucucacguaucggauccgcaacuacacuccacagcuguccgaggcagaaguggagagggccauuaaggaugcguuugaauuguggagcgucgccuccccgcugaucuucacccggauuagucagggggaggcagacaucaauaucgccuuuuaucagcgcgaucauggcgacaacagccccuucgauggcccaaaugggauucucgcacacgccuuucaacccggucagggcaucgggggcgacgcgcauuucgaugccgaggaaacuuggaccaacaccuccgcaaauuacaaccuguuccugguggccgcccacgaguuuggucauagcuuggggcucgcacacaguuccgacccaggcgcccugauguaucccaauuacgcguucagggaaacgagcaacuacucccugccgcaggaugacauugauggcauccaggccauuuaugggcucaguagcaaccccauccaaccaacuggucccuccaccccaaaacccugugacccaagccugacuuuugacgcaauuaccaccuugcggggcgagauccuguucuuuaaggaucgcuacuucuggaggcggcacccgcagcuccagcgcguagaaaugaauuuuaucagucuguucuggcccucccugccaacugggauucaagccgcauaugaggacuuugauagggacuugaucuuccucuuuaagggcaaccaguacugggcccugagcgguuaugauauucugcagggcuaccccaaagacaucaguaauuauggguucccauccagcgugcaggccauugaugcggcagucuuuuaccggagcaagacguacuucuucgugaacgaccaauuuuggcgcuaugauaaucagaggcaguucauggagcccggcuacccgaaauccaucaguggggccuuuccagguaucgaaagcaagguggacgccgucuuccagcaagagcacuuuuuccauguguuuuccggcccccgguauuacgcauucgaucucauugcccagcgcguaaccaggguggcgcgggggaacaaauggcugaauugcagguauggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6946 - RNA, 2400 nt, Artificial Sequence
  mRNA product Design5 comprising derived and/or modified sequence from Homo sapiens__NP_004985.2__HsMMP9 (opt7)
gggagagucccgcagucggcguccagcggcucugcuuguucgugugugugucguugcaggccuuauucaagcuuaccaugagccuguggcagccccucgugcuggucuugcuggugcucggcugcuguuucgccgcaccaaggcaacggcaguccacccugguauuguuuccgggggaccugcgcacuaaccucaccgauaggcagcuggccgaggaauaccuguaucgguacgguuauacgcgcguggcggagaugaggggcgaaaguaagagccucgggcccgcccuguugcugcuccagaaacaacugucccugccagagacuggcgaauuggacagugcaacccucaaggccaugcggacccccaggugcggugucccagaucuggggagguuccagacuuuugagggcgaccugaaauggcaccaucacaauaucaccuacuggauucagaacuauagcgaggaucucccccgggcagugaucgacgaugccuucgcgcgcgccuuugcacugugguccgccgugacgccauugacuuucaccagggucuacagccgggacgccgauauugugauccaguuuggcguagcagaacauggggacgguuauccguucgauggcaaggacgggcugcucgcccacgcguuucccccaggccccgguauucaaggggaugcccauuucgacgacgaugagcuguggucccugggcaaaggcguggucgugccaacucgcuuugggaaugcagacggugccgcaugucacuuccccuucaucuuugaaggcaggaguuacagcgccugcaccaccgaugggcgguccgacggcuugccgugguguagcacgacugccaacuacgauaccgacgaucgcuucgguuuuugccccagugagaggcucuauacucaggacggcaaugcggaugggaagccaugucaguuccccuuuaucuuccagggccaauccuacagcgcaugcaccaccgacgggcgguccgaugguuaucgcuggugugccacuacggccaacuacgacagggacaagcuguuuggcuucugcccaacccgggcagauaguacugugaugggcgggaauagcgccggugagcugugcgucuuucccuucaccuuucucggcaaagaauauuccaccuguacuagcgaggggaggggcgacgggcgccuguggugcgcgacgaccaguaacuucgauuccgacaagaaauggggcuuuuguccagaucaggguuacagcuuguuccugguggccgcacacgaguucgggcaugcccucggccuggaccacaguuccguaccggaagcacugauguaucccauguaccgguuuacugaagguccacccuugcauaaggaugacgugaauggcauuaggcaccucuacgggccacgccccgagccggagccacggccacccaccaccacuacgccccagcccaccgccccaccgacugucugccccaccggcccacccacugugcacccaagcgaaaggcccaccgccgggccgacgggcccacccagcgcagguccaaccgggcccccgacugccggccccuccaccgcgacuaccgugccacugagucccgucgaugacgccuguaacgugaauaucuucgaugcaauugccgagaucggcaaccaacuguaucucuuuaaagacgggaaguacuggcgcuucagcgaaggucggggcuccaggccacaggggcccuuucugauugccgauaaauggccagcauugccgcggaagcuggacagcguauucgaggaacgccucaguaagaaacuguuuuucuuuuccggccgccaggugugggucuauacgggugcgagcgugcuggggccccggcgcuuggacaagcugggccucggcgccgaugucgcacaggugaccggggcccugagguccggucggggcaaaaugcuccuguucagugggcgcagguuguggcgguuugacgugaaggcccaaaugguagauccaaggagcgcauccgagguggaccgcauguuccccggcgucccacuggauacucaugacguguuccaguaccgggagaaagccuauuuuugccaggauagguucuacuggcgcgucagcagucgguccgaacucaaucagguggaccaaguggguuauguaaccuacgauauccugcagugucccgaggacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6947 - RNA, 1692 nt, Artificial Sequence
  mRNA product Design5 comprising derived and/or modified sequence from Homo sapiens__NP_002418.1__HsMMP13 (opt7)
gggagagucccgcagucggcguccagcggcucugcuuguucgugugugugucguugcaggccuuauucaagcuuaccaugcaccccggcgugcuggccgcauuccucuuucugagcuggacccauugcagggccuugccacugccguccgggggugacgaggaugaccucagugaagaggaucugcaguucgcggaacgguacuugcgcagcuauuaccaccccacuaaccuggccggcauccucaaggagaaugcagccuccaguaugaccgaaaggcugcgggagaugcagagcuuuuucgggcuggaggucacgggcaaacucgacgauaacacucuggacgugaugaagaaaccacgcugugguguacccgaugugggggaauauaaugucuuuccaaggaccuugaagugguccaaaaugaaccugaccuaccggauugugaauuauacucccgacaugacccauagcgagguggaaaaggcauucaagaaagccuuuaaggucugguccgaugugacgccacucaacuucacucgccugcacgacggcaucgcggauauuaugaucaguuuuggcauuaaagagcauggggacuucuacccguuugauggucccagcggccuguuggcccacgcauucccacccgggccaaauuauggcggugacgcccacuucgacgaugacgagaccuggacuuccagcaguaagggguacaaccucuuucugguagccgcacaugaguucggccacucccugggccucgaucauagcaaagaccccggggcccugauguuuccgaucuacaccuauaccgguaagucccacuucauguugcccgaugacgaugugcaaggcauccagagucuguacgggccaggcgacgaggaucccaauccaaaacaccccaagacgccagacaagugcgauccgagccucucccuggacgcgauuacuagccugaggggugaaaccaugaucuuuaaagaccgguucuuuuggcgcuugcauccccagcaagucgaugccgaacucuuccugacuaagaguuuuuggccagaacugcccaacaggauugacgcagccuaugagcacccaucccaugaucucaucuucauuuuucggggccgcaaauucugggcacugaauggguacgacaucuuggagggcuaucccaagaaaauuagcgaacuggggcucccgaaggaggugaagaaaaucagugccgccgugcacuuugaagauaccgguaagacccugcuguucuccggcaaccaggucuggagguacgacgauacuaaucauaucauggacaaagauuauccacgguugauugaggaagacuuccccgggaucggcgauaagguggacgcgguauacgagaaaaacgguuacauuuacuuuuucaauggccccauccaguuugaguauagcauuuggagcaaccgcaucgugagggucaugccagcaaacuccauccucugguguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6948 - RNA, 1344 nt, Artificial Sequence
  mRNA product Design5 comprising derived and/or modified sequence from Homo sapiens__NP_001286.1__HsCCR1 (opt7)
gggagagucccgcagucggcguccagcggcucugcuuguucgugugugugucguugcaggccuuauucaagcuuaccauggagacccccaacacuaccgaagacuacgauacgacuaccgaguucgacuauggcgaugccaccccaugccagaaggugaaugaaagggcauuuggggcccaacugcucccgccccuguacagcuuggucuucgugaucggucugguaggcaacauucucgugguccugguguuggugcaguauaaacggcugaagaauaugacuuccaucuaccuccugaaccuggcgauuagugaccuccuguuuuuguucacccugccauuuuggaucgauuauaaacucaaggacgauugggucuucggggacgccauguguaaaauucugagcggcuuuuacuauacgggucuguacuccgagaucuucuuuaucauuuugcucacuaucgaucgcuaccuggcaauugugcacgccguauucgcacugagggcccggaccgugacuuuuggggucaucaccaguauuaucauuugggcgcucgccauccuggcaagcaugcccggcuuguauuucuccaagacccagugggaauuuacgcaucacacuugcagccugcauuuuccacacgagucccuccgcgaguggaagcuguuccaggcccugaaauugaaucucuuuggccuggugcugccccuccuggugaugaucauuuguuacaccgggaucauuaagaucuugcugaggcggccaaacgagaaaaagaguaaagccguccgccucauuuucgugaucaugaucauuuucuuccuguuuuggacuccguauaaucugaccaucuugauuagcguauuccaagacuuucucuucacccaugaaugcgaacaguccaggcaccuggaucuggcagugcaggucacugaggugaucgccuacacgcacuguugcgugaaccccgucauuuaugcguuugugggugagcgguuccgcaaguaccucaggcagcuguuucaucggcgcguagccgugcacuuggucaaauggcugccauuccucagcguggacaggcuggaacgggucaguuccaccagccccuccacuggcgagcaugaacugagugcaggguucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6949 - RNA, 912 nt, Artificial Sequence
  mRNA product Design5 comprising derived and/or modified sequence from Homo sapiens__NP_002598.4__HsPDGFA (opt7)
gggagagucccgcagucggcguccagcggcucugcuuguucgugugugugucguugcaggccuuauucaagcuuaccaugaggacccuggccugccuccuguugcugggcuguggguaccucgcacacgugcuggccgaggaagcggagaucccccgggaagucauugagcgcuuggccaggagccagauccauuccauucgggaccugcaacgccuccuggaaaucgauaguguggguagcgaggacucccuggauaccagucucagggcacacggcguacaugccacuaagcacgugccagagaaacggccgcugcccauucgcaggaagcggagcaucgaagaggcagucccagccgugugcaaaacgcgcacugugaucuaugaaauucccaggucccaggucgacccaaccagcgcgaacuucuugaucuggcccccauguguggagguaaagcggugcaccggguguugcaauacuuccagugugaaaugucagccgagccgcguccaucacagguccgugaagguggccaaggucgaguacgugcggaaaaagcccaaacugaaggaaguacaggugcgccucgaggaacaccuggagugcgcaugugccaccacgagccugaacccagauuauagggaagaggacacuggccggccccgcgagagugguaaaaagaggaaacggaagagguugaagccaaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6950 - RNA, 1002 nt, Artificial Sequence
  mRNA product Design5 comprising derived and/or modified sequence from Homo sapiens__NP_002599.1__HsPDGFB (opt7)
gggagagucccgcagucggcguccagcggcucugcuuguucgugugugugucguugcaggccuuauucaagcuuaccaugaacaggugcugggcccuguuccucagccuguguugcuacuugcggcugguguccgcagagggcgaccccaucccagaggaacucuaugaaaugcugagugaucacagcauucgcuccuuugacgauuugcagaggcugcuccauggggacccgggugaggaagauggcgccgagcuggaccugaauaugacccggagucacagcgggggcgagcucgaaucccuggcgcgcgguaggcggagcuuggggucccugacuaucgccgagcccgcaaugauugccgaauguaagacccgcacggaggucuucgagaucaguaggcggcucauugaucgcacuaacgcaaauuuucugguguggccacccugcguagaagugcaaagguguagcggcugcuguaacaaucggaacguccagugccgcccaacccaggugcagcugaggcccgugcaaguccggaaaaucgagaucgugcgcaagaaaccaauuuucaagaaagccaccguaacuuuggaagaccaucucgcguguaagugcgagaccguggccgcagccaggccggucacgcggucccccggcgggagccaggaacagcgcgccaagacuccacagaccagggugacuauccggaccgugaggguccgccggcccccaaaagguaagcacaggaaauuuaagcauacccacgauaaaacggcacugaaggagacucugggcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6951 - RNA, 1314 nt, Artificial Sequence
  mRNA product Design5 comprising derived and/or modified sequence from Homo sapiens__NP_057289.1__HsPDGFC (opt7)
gggagagucccgcagucggcguccagcggcucugcuuguucgugugugugucguugcaggccuuauucaagcuuaccaugagccuguucggccuccuguugcugaccuccgcccucgcagggcagaggcaagguacucaggccgagaguaaccugagcuccaaguuucaguucaguagcaauaaagaacagaacggcgugcaagacccccagcacgagcggaucauuaccgucuccacgaaugggagcauccauuccccacgcuuuccgcacacuuaccccaggaacaccguguugguauggcggcugguggcggucgaagagaauguguggauucagcucaccuucgaugaacgcuuuggccuggaggacccagaggaugacaucugcaaguaugauuucguggaagucgaggaacccagugacgguacuauucuggggaggugguguggcagcggcaccgugccagggaaacagaucuccaaggguaaccaaauccggauucgcuuuguaagcgaugaguacuuccccagugagccaggcuuuugcauccauuauaauauugugaugccgcaguucacggaagccgucucccccagcgugcucccacccuccgcacugccauuggaccugcucaacaaugccaucacugcauuuaguacccuggaggaucugauuagguacuuggaacccgagcgguggcagcucgaccuggaagaucuguaucgcccgacuuggcagcuccuggggaaagccuucguguucggcaggaaaagccgggucguggacuugaaccugcucaccgaggagguacgccuguacuccuguacccccaggaauuuuagcgugaguauccgggaggaacugaagcgcacggauacuauuuucuggccagguugcuugcucgucaagaggugugggggcaacugcgcguguugccugcacaauuguaacgaaugccaaugcgugcccuccaaggugaccaaaaaguaucaugagguccugcagcuccggccaaaaacuggcgugcgcgggcugcacaagagcuugaccgacguagcccuggaacaccaugaggagugugacugcguguguagggguaguaccggcgggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6952 - RNA, 1371 nt, Artificial Sequence
  mRNA product Design5 comprising derived and/or modified sequence from Homo sapiens__NP_149126.1__HsPDGFD (opt7)
gggagagucccgcagucggcguccagcggcucugcuuguucgugugugugucguugcaggccuuauucaagcuuaccaugcacaggcugaucuucguguacacccucauuugcgccaacuuuuguagcugccgggacacuuccgcaacgccccagagugccagcaucaaggcgcugcgcaaugccaacuugaggcgggaugaccuguaucgcagggaugagaccauucaagucaaaggcaauggguacgugcaguccccacgguucccgaacaguuauccccgcaaucuccuguugacuuggaggcugcauagccaggaaaacacccggauccagcucguauuugacaaucaauucggucuggaggaagcagagaacgauauuugucgcuacgacuuuguggaagucgaggauaucuccgagaccagcacuaucauuaggggccgguggugcgggcacaaggaagugccaccccgcaucaaauccaggaccaaucagauuaagaucacguucaaaagugacgauuauuuuguggccaagccaggcuucaagauuuacuauagccugcucgaggacuuucagcccgcagccgcguccgaaacuaacugggagagcgucaccaguuccaucagcgguguguccuacaauaguccaagcguaacugauccgacccugauugccgacgcauuggauaaaaagaucgccgaguucgacaccguggaagaccugcucaaauacuuuaaccccgaguccuggcaggaagaucuggagaauauguaucuggacacgccacgguaccgcgggaggagcuaucaugaucggaagaguaaagucgacuuggaucgccucaacgacgaugccaagagguacuccuguacuccccggaauuauagcgugaacaucagggaggaacugaaacuggcaaacguggucuucuucccacgcugccuccuggugcaacgguguggcggcaauugcgggugugguaccguaaacuggaggaguugcacuugcaauuccggcaagaccgugaagaaauaccacgaggucuugcaguuugaacccgggcauauuaagcgccggggcagggccaaaaccauggcgcugguggacauccagcucgaucaccacgagcgcugugacugcauuuguagcagccggccgcccaggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6953 - RNA, 954 nt, Artificial Sequence
  mRNA product Design5 comprising derived and/or modified sequence from Homo sapiens__NP_003946.3__HsSOCS3 (opt7)
gggagagucccgcagucggcguccagcggcucugcuuguucgugugugugucguugcaggccuuauucaagcuuaccauggugacccacagcaaguuccccgccgcaggcauguccaggccacuggacaccagucuccggcugaaaacuuuuagcuccaagagugaguaccaguuggucgugaacgccguacgcaaacugcaagaaagcggguucuauugguccgcggugacggguggcgaggccaaucuccuguugagcgcagaaccggccgggacuuuucugaucagggauuccagugaccagcggcauuucuuuacccucagcgucaagacccaguccggcacuaaaaaccugcgcauucagugcgagggugggagcuucagucugcaauccgaucccaggagcacccagccagugccccgguuugacugugugcucaagcugguccaccauuacaugccacccccaggcgcaccguccuuccccaguccacccacggaaccaagcuccgaggugcccgagcagccgagcgcccagcccuugccaggcagucccccacgcagggcguauuacaucuauuccgggggugaaaagauuccccugguacucagccggccacugaguuccaauguggccacucugcaacacuugugccgcaaaaccgucaacggccaucucgauagcuacgagaaggugacucagcugccggggcccaucagggaauuucuggaccaguaugaugcaccacucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6954 - RNA, 759 nt, Artificial Sequence
  mRNA product Design5 comprising derived and/or modified sequence from Homo sapiens__NP_003227.1__HsTGFA (opt7)
gggagagucccgcagucggcguccagcggcucugcuuguucgugugugugucguugcaggccuuauucaagcuuaccauggugcccagcgccggccagcuggcacucuucgcccuggggaucgucuuggcggccugccaagcacuggagaacuccaccaguccacucagcgccgacccgcccguggcagccgcgguagugucccacuuuaaugauuguccagacagucauacucaguucugcuuucacgguaccuguagguuccugguccaggaagauaagcccgccugcgugugucauagcggcuacgugggggcacggugcgagcacgccgacuugcuggccgucguggcagccucccagaaaaagcaagcgauuacggcccucguaguggucagcaucguggcacuggccgugcugauuaucacuuguguccucauucauugcugucaggugcgcaaacacugcgaauggugcagggcacugaucugucggcacgagaagccauccgccuugcugaaaggccgcaccgccugcugucauagugaaaccguagugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6955 - RNA, 1449 nt, Artificial Sequence
  mRNA product Design5 comprising derived and/or modified sequence from Homo sapiens__NP_000651.3__HsTGFB1 (opt7)
gggagagucccgcagucggcguccagcggcucugcuuguucgugugugugucguugcaggccuuauucaagcuuaccaugcccccaagcggccugaggcuccugccguugcugcucccccuguuguggcugcucgugcugaccccagggcggcccgccgcaggucuguccacuugcaagaccaucgacauggagcucgucaaacgcaagaggauugaagccauccggggccagauucugaguaaauugcgccuggcgagcccacccucccaaggggaggugccaccgggcccccucccagaagccguacuggcacuguacaacaguacgagggaucggguggccggugagagcgcagaacccgagccagagcccgaagccgacuauuacgcgaaggaggucacucgcguguugaugguggaaacccacaaugagaucuaugauaaauucaagcaguccacccauagcauuuacauguuuuucaacacuuccgagcucagggaagccgucccggagcccgugcugcugagucgggcagaacuccgccuguugaggcugaagcucaaaguagagcagcacguggaacuguaucagaaguacagcaauaacuccuggcgguaucugagcaaucgcuugcucgccccaagugacucccccgaguggcugagcuuugaugucaccgggguggugaggcaauggcugucccggggcggcgagaucgaaggguuccgccucagugcccauuguagcugcgacuccagggauaacacgcugcaggucgacaucaaugguuuuacuaccggccggcgcggggauuuggcaacuauucacggcaugaacaggccauuccugcuccugauggccacgccccuggagcgggcgcagcauuugcagagcaguaggcaccgccgggcccucgacaccaauuacuguuuuuccagcaccgagaaaaacugcugugugaggcaacuguacaucgauuuccgcaaggaccuggguuggaaauggauucacgaaccaaagggguaucaugcaaauuuuugccucggcccgugucccuacaucuggagucuggauacucaguauuccaaaguauuggcccuguacaaccagcacaauccaggcgcaagcgccgcccccugcugugugccacaggcgcucgaaccccugccgauugucuauuacguggggcggaagccaaagguggagcaacugagcaacaugaucgucagguccugcaaaugcaguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6956 - RNA, 1521 nt, Artificial Sequence
  mRNA product Design5 comprising derived and/or modified sequence from Homo sapiens__NP_003229.1__HsTGFB2 (opt7)
gggagagucccgcagucggcguccagcggcucugcuuguucgugugugugucguugcaggccuuauucaagcuuaccaugcacuacugcgugcugagcgccuuccucauccugcauuuggucaccguggcacugucccucaguacuuguagcacccuggacauggaucaguuuaugaggaagcggauugaggccauccgcggccaaauuuuguccaaacugaagcucacgagucccccagaagacuauccggagcccgaagagguaccacccgaagugaucagcauuuacaacuccacuagggaucugcugcaggagaaagcgagccggcgcgccgcagccugcgagagggaacgguccgacgaggaauauuacgcaaaggaggucuauaaaaucgauaugccacccuucuuuccaagugagaaugccaucccgcccaccuucuaccgcccauauuuuaggauugugcgguucgacgugagcgcgauggaaaagaacgccuccaaucucgucaaggcagaguuucgcguguucaggcugcagaaccccaaagcccggguaccagaacagcgcaucgaguuguaccaaauucucaagagcaaagaucugaccagucccacucagagguacaucgacuccaagguggucaaaacccgggccgaaggggaguggcugagcuuugaugugacggacgcagugcacgaguggcugcaucacaaggaucgcaauuuggguuucaaaauuucccuccauuguccgugcuguacuuuuguccccaguaacaauuauaucauuccaaacaagagcgaggaacuggaagccagguucgcgggcaucgacgggaccuccacuuacaccagcggcgaucagaagaccaucaaaaguacgcggaagaaaaauuccgguaagacuccccaucugcuccugauguugcugccaagcuaucgccucgagagucagcaaaccaacaggcggaaaaagagggcccuggacgcagccuacugcuuccgcaaugugcaggacaacuguugccugcggcccuuguauauugauuuuaagagggaccucggguggaaauggauccacgaaccaaagggcuacaaugcaaacuucugugccggcgccugcccguaucugugguccagcgauacucagcacagccgcguacugucccucuacaauaccauuaaccccgaggcgagugcaagcccaugcugugugucccaggaccuggagcccuugaccauccuguacuauauugggaaaacuccaaagaucgaacaacucagcaacaugaucgucaaaaguugcaaguguuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6957 - RNA, 1515 nt, Artificial Sequence
  mRNA product Design5 comprising derived and/or modified sequence from Homo sapiens__NP_003230.1__HsTGFB3 (opt7)
gggagagucccgcagucggcguccagcggcucugcuuguucgugugugugucguugcaggccuuauucaagcuuaccaugaagaugcaucugcagagggcccucgugguccuggcauugcugaacuucgccaccgugagccucucccugaguacuugcaccacguuggacuuuggccacaucaaaaagaaacggguagaggcgauucgcgggcaaauccugagcaagcucaggcugacuuccccacccgaaccgaccgugaugacccacguccccuaccaggugcuggcccucuauaauaguacucgggagcuguuggaagagaugcauggugaacgcgaggagggcuguacccaggaaaacacggagagcgaauacuaugcaaaagagauucacaaguucgauaugauccaggggcuggccgagcauaaugaacucgcagugugcccaaagggcauuacuuccaaagucuuuagguucaacgugagcuccguagagaagaaucggaccaaccuguuucgcgccgaguucagggugcugcggguccccaauccaaguagcaaacgcaacgaacaaaggaucgaauuguuucagauccuccggcccgacgagcacauugcgaagcagcgcuacaucggugggaaaaaucugccaacuaggggcaccgccgaguggcuguccuucgaugugaccgacacggugcgggaauggcuccugcgcagggagagcaacuugggccuggaaauuaguauccacuguccgugccauacuuuucagcccaauggggauauucucgagaacauccacgaagucauggagauuaaguucaaagguguggacaaugaggaugaccauggccgcggggaucugggccggcugaagaagcaaaaagaccaccacaacccacauuugauccucaugaugauucccccacacaggcuggauaaucccggucaagggggccagcggaagaaaagggcacuggacaccaacuauuguuuucgcaaccucgaagagaauugcuguguacggccgcuguacaucgauuucaggcaggacuugggcuggaagugggugcaugaacccaaaggguauuacgccaacuucugcuccgguccaugucccuaccugcgcagcgccgacacuacccacuccaccguccucggccuguauaauacucugaacccagaggcaagugccagccccugcugcgugccacaggauuuggaaccgcucacgauccuguacuauguggggcggacccccaaggucgagcagcuguccaauauggugguaaagagcuguaaaugcaguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6958 - RNA, 1662 nt, Artificial Sequence
  mRNA product Design5 comprising derived and/or modified sequence from Homo sapiens__NP_001057.1__HsTNFRSF1B (opt7)
gggagagucccgcagucggcguccagcggcucugcuuguucgugugugugucguugcaggccuuauucaagcuuaccauggcccccguggcagucugggccgcgcuggccgugggccucgagcugugggcagccgcacacgccuugccagcgcagguagccuucaccccguacgcacccgaaccagggagcacuugcaggcugcgggaguauuacgaccaaaccgcccagauguguugcuccaaguguagucccggucagcaugccaaaguguuuugcacgaagacuagcgauaccgucugugacuccugcgaagauaguaccuauacucagcucuggaacugggugccagagugucugagcugcggcucccgcuguagcuccgaccaaguggaaacccaggcaugcacgagggagcagaaucggaucugcacuugucgccccgggugguacugcgccuugaguaaacaggagggcuguaggcugugcgcgccacuccggaagugucgcccggguuucggggucgccaggcccggcaccgaaacuagcgaugugguaugcaaaccaugugcacccggcaccuuuuccaacaccacgagcaguacugacauuugccggccacaccaaaucuguaauguggucgccauucccgggaacgcauccauggaugccgugugcaccagcacuuccccgacccgcaguauggcccccggugcggugcaucugccacagcccgucagcaccaggucccagcacacucagccaacgcccgagccaagcaccgcaccgaguacuuccuuccugcuccccaugggcccaagucccccagccgaagggagcaccggcgacuuugcccugcccguggguuugaucguaggggugaccgcacugggccuccugauuaucggcgucgugaauugcgugaucaugacucaagucaagaagaaaccgcuguguuugcagcgggaggccaaggugccacaucuccccgcggauaaagcccgcgggacgcagggucccgagcaacagcaucugcugauuaccgcaccauccagcagcuccaguagccucgaauccagcgccagugcacuggacaggcgggcccccacucgcaaccagccacaggccccgggcguagaggcauccggggccggcgaagcgagggccagcaccgguuccagugauagcucccccggcgggcacggcacccaagugaaugucacuugcaucgugaacgucuguagcaguuccgaccacagcucccagugcaguagccaggcauccagcacgaugggggauaccgacaguuccccaagcgagucccccaaggacgaacaggugccauucagcaaagaggagugugccuuucggagucaauuggaaacucccgagacccugcucgguagcacugaagagaagccgcugccacugggcgugcccgaugccgggaugaaaccauccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6959 - RNA, 789 nt, Artificial Sequence
  mRNA product Design5 comprising derived and/or modified sequence from Homo sapiens__NP_002623.2__HsPGF (opt7)
gggagagucccgcagucggcguccagcggcucugcuuguucgugugugugucguugcaggccuuauucaagcuuaccaugcccgugaugaggcuguucccaugcuuucuccagcuguuggccggccuggcacucccggccgugcccccacaacagugggcgcugagcgccgggaacgguuccagugaggucgaaguagugcccuuccaggaggucuggggccggagcuacugucgcgcauuggaaaggcugguggacguggucuccgaguauccaagugaaguggagcacauguuuagccccuccugcguaagccuccugcgguguaccgggugcuguggcgaugagaaucugcauugcgugccagucgaaacugccaacgugaccaugcagcuccugaagauccgcuccggugacaggccgaguuacguggaguugacguucagccaacacguccggugugaaugccgcccccugagggagaaaaugaagccagagcggcgcaggcccaaagggcggggcaagcgcaggcgggaaaaacagcgcccaacugauugucaucucugcggcgacgcagugcccaggcggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6960 - RNA, 1515 nt, Artificial Sequence
  mRNA product Design5 comprising derived and/or modified sequence from Homo sapiens__NP_001020537.2__HsVEGFA (opt7)
gggagagucccgcagucggcguccagcggcucugcuuguucgugugugugucguugcaggccuuauucaagcuuaccaugaccgacaggcagacugauaccgcccccagcccauccuaccaucugcucccgggccggcgcaggacgguggacgcagccgcgagucgggggcaaggucccgagccagcccccggcgggggcgucgaaggugugggggcacgcggcguagcccugaaguuguucgugcagcugcucggcugcagcagguuugggggugcagucgugcgggccggcgaggcggaaccauccggggccgcacgcagugccagcuccggcagggaggaaccccagccagaggagggugaagaggaagaggagaaagaagaggaacgggggccgcaguggcgccugggcgccaggaagcccggcagcuggacuggggaggcagccgugugugcggauuccgccccagcagcccgggcaccccaagccuuggcccgcgcgagugguaggggcgggcgggucgcacgcaggggcgccgaagagagcgguccaccccacuccccgagccggcgcggcagugccuccagggcagggcccggccgggccagcgagaccaugaacuuccugcucuccugggugcacuggagucuggcgcugcuccuguauuugcaucacgccaaauggagccaggcagccccaauggcagaaggggguggccagaaucaucacgagguagugaaguuuauggacgucuaccagagguccuauugccaccccaucgaaacccugguggauauuuuccaagaguacccagacgaaaucgaguauauuuuuaaacccagcugugugccacucaugcgcugcgggggcuguugcaacgaugagggucuggaaugugucccgacugaggaaaguaauaucaccaugcagauuaugcggaucaagccccaucagggccagcacaucggggagauguccuuccugcaacauaacaagugcgaauguaggcccaaaaaggaccgcgcccggcaggagaaaaagagcgugaggggcaaagggaagggccagaaacgcaagcggaagaaaaguagguacaaguccuggagcguauaugugggugcccggugcugcuugaugccauggagccucccagggccccacccguguggcccaugcuccgagcgcaggaaacaccuguuuguccaagauccccagacguguaagugcaguuguaaaaauacugacagccggugcaaggcacgccagcuggaacucaacgagaggaccugucggugcgauaagcccaggcgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6961 - RNA, 975 nt, Artificial Sequence
  mRNA product Design5 comprising derived and/or modified sequence from Homo sapiens__NP_001165094.1__HsVEGFA (opt7)
gggagagucccgcagucggcguccagcggcucugcuuguucgugugugugucguugcaggccuuauucaagcuuaccaugaacuuccugcucagcugggugcacuggucccuggccuugcugcucuaccugcaucacgcaaaguggagucaggccgcgcccauggccgagggcgggggucaaaaucaucacgaagucgugaaauuuauggacguauaucagaggagcuacugccauccaaucgagaccuugguggauauuuuccaggaauauccggacgagaucgaauacauuuuuaagcccuccugugucccacugaugcggugcggcggguguugcaacgaugagggccucgagugugugcccacugaagagaguaauaucaccaugcagauuaugcgcaucaaaccacaccaaggucagcacaucggggaaaugagcuuccugcagcauaacaagugcgaguguaggcccaaaaaggaccgggcacgccaggagaagaaauccgugaggggcaagggcaaagggcaaaagcggaaacgcaagaaaagcagguauaaguccuggagugucuacgugggugcccggugcugucugaugccauggagccucccgggcccccacccaugcgggcccugcuccgaacgcaggaagcaucuguuuguacaggauccacagacguguaaaugcagcuguaagaauacugacagucggugcaaagcacgccaguuggagcugaacgaaaggaccugucggugcgauaagcccaggcgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6962 - RNA, 900 nt, Artificial Sequence
  mRNA product Design5 comprising derived and/or modified sequence from Homo sapiens__NP_003368.1__HsVEGFB (opt7)
gggagagucccgcagucggcguccagcggcucugcuuguucgugugugugucguugcaggccuuauucaagcuuaccaugagcccccugcucaggcggcuguugcuggccgcacuccugcaguuggccccagcgcaagccccggugucccagcccgacgcaccaggccaccagcgcaaggucgugaguuggaucgauguauacaccagggccacuugccagccccgggagguggucgugccacugaccguggaacucauggggacggucgcaaaacaacuggugcccagcuguguaacugugcagcgcugcgguggcuguugcccagacgaugggcuggagugugucccgaccggccagcaucaggugaggaugcaaauucucaugauccgguaucccuccagucagcugggugaaaugagcuuggaggaacacucccagugcgagugucgcccaaagaaaaaggacagcgccgugaaacccgauagggcggccaccccacaucaccggccccagccgcgcuccguccccgggugggacagugcaccaggcgcccccagcccagccgauauuacucaucccaccccagcaccgggccccuccgcccacgcggccccaagcacgaccagugcacugacucccgggccagccgcagccgccgcggacgcagccgccuccagcguggcaaaggguggcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6963 - RNA, 1536 nt, Artificial Sequence
  mRNA product Design5 comprising derived and/or modified sequence from Homo sapiens__NP_005420.1__HsVEGFC (opt7)
gggagagucccgcagucggcguccagcggcucugcuuguucgugugugugucguugcaggccuuauucaagcuuaccaugcaucugcucggcuucuuuagcguggccugcucccuguuggcagccgcgcugcuccccgggccaagggaggccccggcagccgcagccgcguucgaaaguggucuggacuugagcgaugccgagcccgacgcaggcgaagccaccgccuacgcauccaaggaucuggaggaacagcuccggagugucagcuccguggacgagcugaugacuguacuguauccagaguacuggaaaauguauaagugucaacuccgcaaagggggcuggcagcacaacagggaacaggccaaucugaacagccggaccgaggaaacgaucaaguuugcggccgcacacuacaauacugagauuuugaaauccaucgauaacgaguggcgcaagacccagugcaugcccagggaaguguguauugacgucgguaaggaguucgggguggccaccaauacuuucuucaaaccacccugcgugagugucuaucgguguggcggcugcuguaacagcgaagggcugcaaugcaugaauaccuccacgagcuaccucaguaagacucuguuugagaucaccgugccacugucccaggguccgaaacccguaacuauuagcuucgcaaaccauaccuccugucgcugcaugaguaaguuggauguguauaggcagguccacagcaucauccggcgcucccucccagccacccugccccagugccaagccgcgaauaaaacguguccaacuaacuacauguggaauaaccauauuuguaggugccuggcacaggaagacuuuauguucagcagugaugccggcgacgauuccaccgacggguuucacgauaucugcggccccaauaaggagcucgacgaggaaacuugucagugcgugugucgggccggucugcgcccggcaagcugcgggccccacaaagaguuggacaggaacaguugucagugcgugugcaagaauaagcuguucccaucccaauguggcgccaaccgggaauuugaugagaauaccugccagugugucugcaaacgcaccugucccaggaaccagccacucaaccccggcaagugcgcgugugaaugcacugagagcccacaaaaaugucugcugaaggggaaaaaguuucaucaccagacgugcagcuguuaccggcgcccgugcaccaauaggcagaaggccugcgagcccgguuucuccuauagugaagaggugugucggugcguaccaagcuacuggaaaaggccccagauguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6964 - RNA, 1341 nt, Artificial Sequence
  mRNA product Design5 comprising derived and/or modified sequence from Homo sapiens__NP_004460.1__HsVEGFD (opt7)
gggagagucccgcagucggcguccagcggcucugcuuguucgugugugugucguugcaggccuuauucaagcuuaccauguacagggaguggguggucgugaacguauucaugaugcuguaugugcagcucguccaaggcagcuccaaugaacacgggcccgugaagcggaguagccaguccacccuggagcgcagugaacagcagaucagggccgcaagcuccuuggaggaacugcuccggauuacucauagcgaggacuggaaacuguggcgcugcagguugcggcugaaguccuuuaccaguauggauagccgcuccgccagccacaggaguacgcgguucgcggccacuuuuuacgacaucgagacccucaaagugauugaugaagaguggcaacgcacccaguguuccccaagggaaacuugcgucgagguggcaagcgagcuggguaaguccaccaacacguucuuuaaaccgcccuguguaaauguguuccggugcggcggguguugcaacgaagagagucugaucuguaugaauacuagcaccuccuauauuagcaagcagcucuuugaaaucagugucccacugacuuccgugcccgaguuggugccagucaagguggccaaccauaccggcugcaaaugucugcccaccgcaccacgccacccguacagcaucauuaggcggaguauccagauucccgaagaggaccgcugcucccauagcaagaaacucugcccaaucgauaugcugugggacagcaauaaguguaaaugcguacugcaagaggaaaaccccuuggccgguacggaggaucacucccaccuccaggaaccagcgcugugugggccccauaugauguucgacgaggauaggugcgaaugugugugcaagacuccgugucccaaagaccugauucagcacccaaagaauugcaguuguuuugagugcaaggagagccucgaaaccugcugucagaaacauaagcuguuccaccccgauacuugcuccugugaggaccggugcccauuucacacccgccccugugccagcggcaaaaccgcaugcgccaagcauuguagguucccaaaagaaaagcgggccgcacaaggcccgcacaguaggaagaaccccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6965 - RNA, 906 nt, Artificial Sequence
  mRNA product Design5 comprising derived and/or modified sequence from Homo sapiens__NP_061986.1__HsFGF21 (opt8)
gggagagucccgcagucggcguccagcggcucugcuuguucgugugugugucguugcaggccuuauucaagcuuaccauggacuccgacgaaaccggcuucgaacacuccggccucugggucuccguccucgccggccuacuacuaggcgccugccaagcccaccccauccccgacucauccccacuucuacaauucggcggacaagucagacaacgauaccucuacaccgacgacgcccaacaaacagaagcccaucucgaaauaagagaagacggcaccgucggcggcgccgccgaccaaucccccgaaucccuacuccaacucaaagcacucaaacccggcgucauccaaauccucggcgucaaaaccucccgcuuccuaugccaacgccccgacggcgccuuauacggcucccuacacuucgaccccgaagccugcucuuuucgcgaacuccuacucgaagacggcuacaacguauaccaauccgaagcccacggccuaccccuacaccuccccggcaacaaaucaccccaccgcgacccagccccacguggccccgcacgcuuccucccacuaccaggccucccacccgcccuccccgaaccacccggcauccucgcaccccaaccacccgacguaggcuccucagacccccucuccauggucggccccucccaaggccgcucacccucauacgccucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6966 - RNA, 1686 nt, Artificial Sequence
  mRNA product Design5 comprising derived and/or modified sequence from Homo sapiens__NP_002412.1__HsMMP1 (opt8)
gggagagucccgcagucggcguccagcggcucugcuuguucgugugugugucguugcaggccuuauucaagcuuaccaugcacuccuucccaccccuccuccuacuucucuucuggggcguaguaucccacuccuuccccgccacacuagaaacccaagaacaagacguagaccugguccaaaaauaccuagaaaaauacuacaaccucaagaacgauggacgacaagucgaaaaacgccgcaacuccggcccggucguagaaaagcuaaaacaaaugcaagaguucuucggccuaaaagucacuggcaaaccagacgccgaaacccucaaagucaugaaacaaccacgaugcggcgucccagacgucgcacaauucguccucacagaaggcaacccccgaugggaacaaacccaccucaccuaccgaauugaaaacuacacaccugaccugcccagagccgacguagaccacgccauagaaaaagccuuucaacucuggucaaacgucacaccccucaccuuuaccaaagucucggaaggccaagccgacauaaugauuagcuucguucgaggcgaccacagagacaacucccccuucgacggacccggcggcaaccucgcccacgccuuccaacccggcccggguauaggcggagaugcacauuucgacgaagacgaacgcuggacaaacaacuucagagaauacaaccuccaccguguagcagcccacgaacuaggccacucacucggacucucacacagcaccgacaucggagcccuaauguacccauccuacacuuucuccggagacguucaacucgcccaagacgacaucgacggcauccaagcaaucuacggccgcucccaaaacccaguacaacccaucggaccacagacucccaaagccugcgacuccaaacucaccuuugacgcaaucaccaccauccgaggcgaagucauguucuucaaagaccgcuucuacaugcgcacgaaccccuucuacccagaagucgaacucaacuucauaucagucuucuggccccaacuaccaaacggccuugaagcagcauacgaauuugccgacagagacgaaguccgcuucuucaaaggaaacaaauacugggccguccaaggccaaaacguccuucacggcuaccccaaggacauauacuccuccuucggcuucccccgaacagucaaacacaucgacgcggcacuguccgaagaaaauaccggcaagacauacuucuucgucgccaacaaauacuggcgguacgacgaauacaaacgauccauggaccccggcuaccccaaaaugauagcacacgacuucccgggaaucggccacaaagucgaugcaguauucaugaaagacggauucuucuacuucuuccacggcacacgccaauacaaauucgaccccaaaacaaaacgcauccucacccuccagaaagccaacagcugguucaauugccgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6967 - RNA, 1446 nt, Artificial Sequence
  mRNA product Design5 comprising derived and/or modified sequence from Homo sapiens__NP_002412.1__HsMMP1(1-19,100-469) (opt8)
gggagagucccgcagucggcguccagcggcucugcuuguucgugugugugucguugcaggccuuauucaagcuuaccaugcacuccuucccuccccuacuacuccuacuauucuggggagucguaucacacuccuucguccucaccgaaggcaacccucgaugggaacaaacccaccucacuuaccgaaucgagaacuacacccccgaccucccacgagccgacgucgaccacgccaucgaaaaagccuuucaacuaugguccaacgucacaccccucaccuucacuaaaguaagcgaaggccaagccgacaucaugaucagcuucguccgcggagaccaccgagacaauucccccuucgacggcccaggaggcaaccuagcccacgccuuucaaccaggacccggcauaggaggcgacgcccacuucgacgaagacgaacgauggacaaacaacuuccgcgaauacaaccuccacagaguagccgcccacgaauuaggccacucccuaggacucucacacucaaccgacauaggugcccucauguaccccuccuacaccuucagcggcgacguccaacuagcccaagacgacaucgacggcauacaggccaucuacggccgaucucaaaauccaguccaacccauaggaccacagacaccaaaagccugugacuccaaacucaccuucgacgccaucaccaccauacgcggagaagucauguucuuuaaagacagauucuacaugcguaccaaccccuucuacccagaaguagaacuaaacuucauaucugucuucuggccacaacuccccaacggccuagaagcagcauacgaauuugcugacagagacgaaguacgauucuucaaaggcaacaaauacugggccguccaaggccaaaacguacuacacggcuacccaaaagacaucuacuccuccuucggcuucccccgcacagucaaacacaucgaugccgcacucagcgaagaaaacaccggaaaaaccuacuucuucgucgccaacaaauacuggcgauacgaugaauacaaacgauccauggaccccggauaccccaaaaugaucgcccacgacuuccccggaauaggccacaaagucgacgcaguuuucaugaaagacggcuucuucuacuucuuccacggaaccagacaauacaaauucgaccccaaaaccaaacgcauccucacccuccaaaaagccaacuccugguucaacugccgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6968 - RNA, 3633 nt, Artificial Sequence
  mRNA product Design5 comprising derived and/or modified sequence from Clostridium histolyticum__BAA77453.1__ColG (opt8)
gggagagucccgcagucggcguccagcggcucugcuuguucgugugugugucguugcaggccuuauucaagcuuaccaugaagaaaaacauccucaaaauacucauggacucguauucuaaggaauccaaaauccaaaccgucagacgcgucacuagcgucucccuccucgcgguguaccuaacuaugaauacguccagccuaguccucgcaaagccuaucgagaacaccaacgacaccagcauuaaaaacguugagaagcuacgcaacgcgccaaacgaggaaaacucaaagaaagucgaagacagcaaaaaugacaaaguagagcacguuaaaaacauagaagaagccaagguggaacaaguagcaccggaagucaaaagcaaaaguacccuacgcagcgccagcauugccaacaccaacagcgaaaaguacgacuucgaguaucuuaacgggcucagcuacacagaacuaacaaaccugaucaaaaacauaaaauggaaccaaauaaacgguuuguucaacuacagcacagggucacaaaaauucuucggcgauaaaaaccgcguccaggccaucauaaacgcccuacaagaaagcggccgcacauacaccgcgaacgacaugaagggaauagaaaccuucacggagguauuaagggcgggguucuaccuaggcuacuacaaugacggacucucauaccuaaacgaccgcaacuuccaagacaagugcauccccgccaugauagccauacagaaaaacccaaauuuuaaacucggcacggccguccaagacgaaguuauaacauccuuagggaaacucaucggaaacgccucggccaacgccgaaguggugaacaacugcguccccguacuuaagcaauuccgcgaaaaccuaaaccaauacgcacccgacuacguuaaggggaccgcggucaacgaauugauaaaaggaaucgaguucgacuuuagcggagcagcauaugaaaaggacgugaagacaaugcccugguacggcaagauugauccguucauuaacgaacucaaggcccucggacuauacggaaacauaaccucagcaaccgagugggcuucagauguaggcaucuacuaccugagcaaguucggccuauacagcaccaaccgcaacgacauugugcaaaguuuagaaaaagcagucgacauguacaaguacggcaagauugcauuuguagcgauggaacgaauaacgugggacuacgacggcaucggcuccaacggaaagaaagucgaccacgacaaguuccuggaugacgccgagaagcacuaccuccccaagacauacaccuucgacaacggcaccuucaucauccgagccggcgacaaaguaucggaagaaaagaucaagagacuauacugggccuccagagaagucaaaucccaauuccaccgagucgucggaaacgacaaggcccuagaaguaggaaacgccgacgacguauuaacuaugaaaauuuuuaacagcccagaagaauacaaauucaacaccaauauuaacggcguaucaacagacaacggaggacuguacauagaaccccgagggacauucuacacauacgaacggaccccacaacaauccaucuuuagccuggaagaacucuucagacacgaauacacccacuaccuacaggccagauaccuagucgacgguuuauggggacaaggccccuucuacgagaaaaaccgacucacaugguuugacgagggcacagccgaguucuucgcaggaucaacaagaaccagcggcgugcucccgcgaaagucgauccuuggcuauuuagcgaaagacaaaguagaccacagauacagccuaaagaaaacacugaacucaggcuacgacgauagcgacuggauguucuacaacuauggcuucgcaguagcgcacuaccuuuacgaaaaagacaugccgacguucaucaagaugaacaaagcaauacuaaacaccgacguuaaaucguacgacgaaauaaucaaaaagcuguccgacgaugccaacaaaaacacagaauaccaaaaccauauccaggaacucgcggacaaguaccagggggcaggaaucccccuagucucggacgacuaccuaaaagaccacggcuacaagaaagcaagcgaaguauacagugagaucagcaaagccgccucccuaacgaacacaucagugacugcugagaaaagccaguacuucaacaccuucacacuccgaggaacuuacacgggagaaacaucaaaaggcgaguucaaagacugggacgaaaugagcaagaaauuagacggcacccuagaaucacuagcgaaaaacucuuggagcggauacaagacccuuaccgcauacuucacgaacuacagggucaccagugacaacaaagugcaguacgacgucguguuccacggaguucuaacagacaacgccgacaucuccaauaacaaagcaccaaucgccaaggugacggggccaagcacaggagccgucggacgaaacauagaguucucaggcaaagacagcaaggacgaagacgggaagauaguaaguuacgacugggacuucggugacggagcaacaucccgcgguaagaacagugugcacgcauauaagaaggccggaacauacaacguaacccuaaagguaacggacgacaaaggagcgacagcgaccgaaucguuuacuaucgaaauaaagaacgaagacacgaccacuccaauaacaaaagaaauggaaccaaacgaugacaucaaagaagccaacggcccuauagucgaagguguaaccguaaaaggcgaccucaacggcuccgacgacgcagacacguucuacuucgacgugaaagaagacggggacguaacaaucgaacuccccuacuccggcuccucaaacuucaccuggcuaguauacaaggaaggggacgaucaaaaccacaucgcaagcggaaucgauaaaaacaauaguaaaguagggaccuucaaaucgacaaagggaaggcacuacgucuucauuuacaagcacgacagcgccagcaacauaaguuacuccuuaaacaucaaaggacuaggcaacgaaaaacuuaaggaaaaagagaacaacgacucaagcgacaaagcgacuguaaucccaaacuucaauacgacaaugcaagguucccuccucggagacgacucacgggacuacuacagcuucgaagucaaggaagaaggcgaagugaacaucgaacuggacaaaaaggacgaguucggcguaaccuggacccugcaccccgaaagcaacaucaacgacaggaucaccuacggccaaguagacggcaacaaagucagcaacaaagucaaacuccgccccggcaaguacuaccuacuggucuacaaguacagcggcucaggaaacuacgaacuccgcgucaacaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6969 - RNA, 3357 nt, Artificial Sequence
  mRNA product Design5 comprising derived and/or modified sequence from Clostridium histolyticum__BAA77453.1__HsALB(1-18)_ColG(111-1118) (opt8)
gggagagucccgcagucggcguccagcggcucugcuuguucgugugugugucguugcaggccuuauucaagcuuaccaugaaaugggucaccuucauaagccuccucuuucuguucagcagcgcauacucaauagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6970 - RNA, 3705 nt, Artificial Sequence
  mRNA product Design5 comprising derived and/or modified sequence from Clostridium histolyticum__BAA77453.1__HsALB(1-18)_ColG(1-110)_CS-F_ColG(111-1 118) (opt8)
gggagagucccgcagucggcguccagcggcucugcuuguucgugugugugucguugcaggccuuauucaagcuuaccaugaaauggguaaccuucauaucccuccuguuccuauucucaucagcauacagcaugaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6971 - RNA, 3381 nt, Artificial Sequence
  mRNA product Design5 comprising derived and/or modified sequence from Clostridium histolyticum__BAA34542.1__ColH (opt8)
gggagagucccgcagucggcguccagcggcucugcuuguucgugugugugucguugcaggccuuauucaagcuuaccaugaacuuccucaaaauaauccuaaaccgaggcaaaaccaugaagcgcaaaugccucagcaagagacucaugcucgcaaucaccauggcuacaaucuucacaguuaacucaacucuccccaucuacgccgcgguagacaaaaacaacgcaaccgccgccguccaaaaugaaucuaaacgauacacagucagcuaccuaaaaacccuuaacuacuacgaccucguagaccugcucgugaaaaccgaaaucgagaaccucccggaccuguuccaauauuccagcgaugccaaagaguucuacgggaacaaaacacgaaugucguucaucauggacgaaaucggacgccgagcgccccaauacaccgagauugaucauaagggaaucccgacgcucgucgaagucguccgagccggguucuaucucggcuuccacaacaaggaacucaacgagauaaacaaacgcucuuucaaggaacgcgucauaccguccauacuugccauacagaaaaaccccaauuucaagcucggaacagaaguacaagacaaaaucguauccgccaccggccugcuagccggaaacgaaaccgcaccaccagaagucgucaacaacuucacucccauccuucaagacugcaucaagaacaucgacagauaugcauuggacgaccuaaaaucaaaagcacuguucaacguucuagccgcgcccacauaugauauaaccgaauaccucagagcaacaaaggagaaacccgaaaacacucccugguacggcaaaaucgacggcuucaucaacgaacuaaagaaacucgcauuauacggcaaaaucaacgacaacaacaguuggaucauagacaacggcauauaccacaucgcgccacuaggaaaacuacacucuaacaacaaaaucggaaucgaaacacuaaccgaagucaugaagguauaccccuaccugagcaugcaacaccuucaaucugcagaucaaaucaaacgacacuacgacagcaaagacgccgagggaaacaagaucccauuagacaaauucaagaaagaaggaaaagagaaauacugcccaaagaccuacacguuugaugauggcaaaguaaucauaaaggccggcgcacgcgucgaggaagaaaaagucaaacgccuguacugggcgucaaaagaagucaacucccaauucuuccgagucuauggcaucgacaaaccccucgaggaaggcaaccccgacgacauacugacaauggucauuuacaacucgccugaggaauacaaacugaacucagugcuauacggcuacgacaccaacaacggcggcauguacaucgaacccgaaggcacuuucuucacuuacgagagagaggcccaagaauccacguacacacuagaagaacuuuuccgacacgaguacacccacuaccuccaaggccguuacgcagucccgggacaauggggacgaacgaaacucuacgacaacgacaggcugaccugguacgaagagggcggggcggaacuauucgcagggagcaccaggacaucggggauacuucccaggaaauccaucgucuccaacauccacaacacaacacgaaauaaucgguauaaacugagcgauaccguccacucaaaauacggcgcgucauucgaguucuacaacuacgccuguauguucauggacuacauguacaacaaagauaugggaauccucaacaaauuaaacgaccucgcuaagaacaacgacguagacggcuacgacaacuacauaagagaccuauccucaaacuacgcucugaacgacaaauaccaagaccacaugcaggaacgaaucgacaacuacgaaaaccucaccgucccguucgucgccgacgacuaccucgugagacacgccuacaaaaaccccaacgaaaucuacagcgagaucagcgaagucgccaaacucaaggacgcaaaauccgaggucaaaaagucucaauacuucagcaccuucacucuacgcggcucauacacgggcggcgccuccaaaggcaaauuagaagaccaaaaagccaugaacaaguuuaucgacgacagccucaagaaacuugacaccuacucguggaguggcuacaaaacucuaaccgccuacuuuacaaacuacaaagucgacucguccaaccgcgugacauacgacguagucuuccacggguaccuaccgaacgagggagacagcaaaaacagccuccccuacggaaaaauaaacggcacauacaagggaaccgaaaaagagaaaauaaaauucuccuccgaaggcucguucgaccccgaugguaagauaguauccuacgaaugggacuucggagacggcaauaaaagcaaugaggaaaacccagaacacucauacgacaaaguagggaccuacaccguuaaauuaaaagucacggacgacaaaggagagucgagcgucucaaccaccaccgccgagauaaaagaccuauccgaaaacaaacuacccguaaucuauaugcacgucccaaaaucaggcgcacucaaucaaaagguugucuucuauggaaaaggcaccuacgacccggacggcagcauagcgggcuaccaaugggacuuuggcgacgguucggacuucucgucagagcaaaacccuagccauguauacaccaagaaaggagaauacaccguaacccugcgagugauggauucaucuggccaaaugucugagaaaacaaugaaaauaaaaaucaccgacccaguauaccccaucgguaccgaaaaagaaccuaacaacaguaaagaaacugcaagcggacccaucguccccggcauuccugucucaggaaccaucgaaaacaccagcgaucaggacuacuucuacuuugauguaaucacccccggcgaagucaaaaucgacaucaacaaacuaggauacggcggagccacauggguggucuacgacgagaacaauaacgccgucucuuacgcaaccgacgauggacaaaaccucagcgguaaauuuaaagcagacaagcccggacgcuacuacauccaccuauacauguuuaacggcuccuacaugcccuaucgaauuaacauugagggcucaguaggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6972 - RNA, 3342 nt, Artificial Sequence
  mRNA product Design5 comprising derived and/or modified sequence from Clostridium histolyticum__BAA34542.1__ColH (opt8)
gggagagucccgcagucggcguccagcggcucugcuuguucgugugugugucguugcaggccuuauucaagcuuaccaugaaaagaaaaugccuauccaaacgccucaugcuugcaauaacaauggccacaauauuuaccgucaacuccacccuaccaaucuacgccgccguagauaaaaacaacgcaacagcagccguccaaaacgagagcaaacgauacaccguaucauaccucaagacccuaaacuauuacgaucuaguggaccuccucguaaagacggagaucgaaaacuuaccggaucuauuucaauacuccuccgacgcaaaagaguucuacgguaacaagacacgaauguccuucaucauggacgaaaucggacggcgcgcaccccaauacaccgaaaucgaccacaaaggcauacccacccuugucgaaguuguacgagccggcuucuacuuaggauuccacaacaaggaacucaacgaaaucaacaaacgcuccuucaaagaacgagucauccccuccauccucgcuauucagaagaacccaaacuucaagcucgggaccgagguacaagauaagauagucagcgccaccggccugcuggccggcaaugagaccgcgcccccagagguaguaaacaauuucaccccaauccuacaagauugcaucaagaauaucgaccgcuacgcccuggacgaccuaaaauccaaggcccucuucaacgugcuggccgcgcccaccuacgauaucaccgaauaccucagagcuaccaaagagaaacccgagaacacucccugguauggcaagauagacggcuuuauaaacgaacucaaaaagcuagcacuguacggcaagaucaaugauaacaauucauggaucaucgacaacgggauauaccacauugccccguuagguaaacugcacagcaacaauaaaauaggaaucgagacccuaacugaggucaugaaaguauaucccuaucuuagcaugcaacaccuacaauccgcggaccaaaucaagcgccacuacgacagcaaagacgcugaggggaacaaaaucccccuggacaaguucaagaaagagggcaaggagaaauacugcccaaaaaccuacaccuucgacgacggcaaagucauaaucaaagccggcgcgagaguagaggaagaaaaaguaaagcggcucuacugggccagcaaagaagucaacagucaauucuuccgcgucuacggcaucgauaaaccacuagaagagggaaaucccgacgacauacuaacaaugguaauauacaacagcccagaggaguacaaacugaacuccguccuuuacggauacgauacaaacaacgggggaauguauauagaaccggaaggcacauuuuucaccuacgaacgcgaggcccaggaaucaacauauacacucgaggaguuauuccgccacgaauacacccacuaccuacagggacgcuacgcaguaccagggcaguggggccgcacaaagcucuacgauaacgaccgccuaacgugguacgaagaagggggcgccgaacucuucgccggauccacccgcaccagcgggauccuaccgcgaaagaguauagugagcaacauccauaacaccacgcgcaacaaccgcuacaagcucucagacacaguccacagcaaguacggagcaucguucgaguucuacaacuacgcauguauguucauggacuacauguacaacaaagacaugggcauccucaacaaacucaacgaucucgcgaaaaauaacgacgucgacggauacgacaacuauauccgcgaccucucauccaacuacgcacucaacgacaaauaccaagaccacaugcaggaacgaauagacaacuacgaaaauuuaaccguaccauucguagccgacgacuaccuaguacgacacgccuacaaaaacccuaacgaaaucuacuccgagaucuccgaaguugccaaacucaaagaugccaaaucagaagucaagaaaucccaguacuucagcacauucacucugagaggcagcuacacgggcggcgcguccaaaggaaaacuagaagaucagaaagccaugaacaaauucaucgacgacucucuaaagaaacucgacacauacucguggagcgguuacaaaacacugacugccuacuuuaccaacuacaaagucgacaguucaaaucgagucaccuacgacgugguauuucacgguuaccuacccaacgaaggggacuccaaaaacucacuaccuuacggaaaaauaaaugggaccuacaaaggcacagaaaaagagaaaaucaaauucuccuccgaaggcagcuucgacccugacggaaagaucgugagcuaugaaugggacuucggcgacggcaacaaaucaaacgaagaaaaccccgagcauucauaugacaagguaggaaccuacacagucaagcugaaaguaaccgacgacaaaggggaaucaagcguaagcacuaccaccgccgagaucaaggacuuaagcgaaaacaaacugccaguaauuuauaugcacgucccaaaaucaggcgcccuaaaccagaaggugguauuuuacgguaaagggacguacgaucccgacggcagcaucgccggcuaucagugggacuucggugacggcagcgacuucucaagcgaacaaaaccccagccacguuuacacgaaaaagggcgaauacacagugacacuuagagucauggauagcucgggucaaaugagugagaaaacgaugaaaauaaagaucaccgaccccguguaccccaucggcaccgaaaaggaaccgaacaacucaaaagaaaccgccuccgggcccaucguacccgggaucccuguaucuggcacaauagaaaacacaagcgaccaagacuacuucuacuucgacgucauaacccccggcgaagucaaaaucgauaucaacaaacucggauacggcggagcgacauggguaguguacgacgaaaacaacaacgcaguauccuacgccacagacgacggccaaaaccucuccggcaaauucaaggccgacaagcccggacgauacuacauacaccucuacauguucaacggaucauacaugcccuaccggauaaacaucgaaggaucggugggacgguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6973 - RNA, 3276 nt, Artificial Sequence
  mRNA product Design5 comprising derived and/or modified sequence from Clostridium histolyticum__BAA34542.1__HsALB(1-18)_ColH(41-1021) (opt8)
gggagagucccgcagucggcguccagcggcucugcuuguucgugugugugucguugcaggccuuauucaagcuuaccaugaaaugggucacauuuaucagccuccuuuuccuuuucagcucggccuacagcguccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
